United States Patent
Kim et al.

(10) Patent No.: US 11,104,878 B2
(45) Date of Patent: *Aug. 31, 2021

(54) LACTIC ACID BACTERIA CAPABLE OF CONTROLLING BLOOD SUGAR AND USE THEREOF

(71) Applicant: University-Industry Cooperation Group of Kyung Hee University, Yongin-si (KR)

(72) Inventors: Dong Hyun Kim, Seoul (KR); Myung Joo Han, Seoul (KR); Su Min Lim, Seoul (KR); Sang Yun Lee, Seoul (KR)

(73) Assignee: UNIVERSITY-INDUSTRY COOPERATION GROUP OF KYUNG HEE UNIVERSITY, Yongin-si (KR)

( * ) Notice: Subject to any disclaimer, the term of this patent is extended or adjusted under 35 U.S.C. 154(b) by 17 days.

This patent is subject to a terminal disclaimer.

(21) Appl. No.: 16/303,320

(22) PCT Filed: Sep. 7, 2016

(86) PCT No.: PCT/KR2016/009995
§ 371 (c)(1),
(2) Date: Nov. 20, 2018

(87) PCT Pub. No.: WO2017/204415
PCT Pub. Date: Nov. 30, 2017

(65) Prior Publication Data
US 2020/0063089 A1    Feb. 27, 2020

(30) Foreign Application Priority Data
May 24, 2016   (WO) ................ PCT/KR2016/005493

(51) Int. Cl.
| | | |
|---|---|---|
| *C12N 1/20* | (2006.01) | |
| *A23L 33/135* | (2016.01) | |
| *A61P 1/16* | (2006.01) | |
| *A61P 3/04* | (2006.01) | |
| *A61P 3/10* | (2006.01) | |
| *A61P 29/00* | (2006.01) | |
| *A61P 1/04* | (2006.01) | |
| *A61K 35/00* | (2006.01) | |
| *C12R 1/225* | (2006.01) | |

(52) U.S. Cl.
CPC ............. *C12N 1/20* (2013.01); *A23L 33/135* (2016.08); *A61P 1/04* (2018.01); *A61P 1/16* (2018.01); *A61P 3/04* (2018.01); *A61P 3/10* (2018.01); *A61P 29/00* (2018.01); *C12N 1/205* (2021.05); *A61K 2035/11* (2013.01); *C12R 2001/225* (2021.05)

(58) Field of Classification Search
CPC ......... C12N 1/20; A23L 33/135; C12R 1/225; A61K 2035/115
See application file for complete search history.

(56) References Cited

FOREIGN PATENT DOCUMENTS

| KR | 100872911 B1 | * 12/2008 |
|---|---|---|
| KR | 10-1010914 B1 | 1/2011 |
| KR | 10-1061219 B1 | 9/2011 |
| KR | 10-2012-0100608 A | 9/2012 |
| KR | 10-1407980 B1 | 6/2014 |
| KR | 10-2015-0098202 A | 8/2015 |
| KR | 10-2016-0108751 A | 9/2016 |

OTHER PUBLICATIONS

Lee et al., "Lactobacillus sakei OK67 ameliorates collagen-induced arthritis in mice by inhibiting NF-κB activation and restoring Th17/Treg cell balance" Journal of functional foods 2015 v. 18 pp. 501-511, abstract (Year: 2015).*
Ji et al., "Modulation of the murine microbiome with a concomitant anti-obesity effect by Lactobacillus rhamnosus GG and Lactobacillus sakei NR28", Beneficial Microbes, Mar. 2012; 3(1): 13-22 (Year: 2012).*
U.S. Appl. No. 16/303,401 (Year: 2018).*
Int'l Search Report dated Feb. 20, 2017 in Int'l Application No. PCT/KR2016/005493.
Lim et al, "Lactobacillus sakei OK67 ameliorates high-fat diet-induced blood glucose intolerance and obesity in mice by inhibiting gut microbiota lipopolysaccharide production and inducing colon tight junction protein expression," Nutrition Research, vol. 36, pp. 337-348 (Apr. 2016).
NCBI Reference Sequence No. KC416998.1 (Sep. 2013).
Kook et al, "Effect of Gamma-aminobutyric Acid Produced by Lactobacillus sakei B2-16 on Diet and Exercise in High Fat Diet-induced Obese Rats," Food Science and Biotechnology, vol. 23, No. 6, pp. 1965-1970 (2014).
Cah et al, "Final Report of Studies on the antiinflammatory efficacy and anti-obesity/diabetic effect of functional materials producing microbial strains isolated from fermented food (Kimchi)," (Jul. 17, 2013).
Database GenBank, Apr. 1, 2009, Lactobacillus curvatus gene for 16S ribosomal RNA, partial sequence, strain: KH9, AB494734.1.
Int'l Search Report dated Feb. 20, 2017 in Int'l Application No. PCT/KR2016/009995.
Lee, Sang-Yun, "The anti-inflammatory effects of Lactobacillus sakei OK67 in mice with collagen II-induced arthritis," Department of Life and Nanopharmaceutical Sciences Kyung Hee University (Feb. 2016).

(Continued)

*Primary Examiner* — Ruth A Davis
(74) *Attorney, Agent, or Firm* — Sughrue Mion, PLLC

(57) ABSTRACT

A *Lactobacillus* species strain isolated from kimchi or human feces is described. The particular *Bacillus* species strain described is highly safe by being isolated from kimchi or human feces and has various functionalities, such as excellent blood sugar control activity, anti-obesity activity, blood cholesterol-lowering activity, blood neutral lipid-lowering activity, arteriosclerosis-inhibiting activity or inflammation-inhibiting activity. Accordingly, the particular *Bacillus* species strain described can be used as a useful food and drug material for preventing, alleviating or treating a metabolic syndrome including diabetes, obesity, fatty liver, glycosuria, hyperlipidemia, cardiovascular disease, hypertension, arteriosclerosis and/or diabetes, an inflammatory disease, and the like.

3 Claims, 34 Drawing Sheets
Specification includes a Sequence Listing.

(56) References Cited

OTHER PUBLICATIONS

Lee et al, "Lactobacillus sakei OK67 ameliorates collagen-induced arthritis in mice by inhibiting NF-Kappa-B activation and restoring Th17/Treg cell balance," Journal of Functional Foods, vol. 18, pp. 501-511 (2015).
Moon et al., Anticariogenic activities of Lactobacillus sakei K-7 isolated from kimchi, 26 Korean society for biotechnology and bioengineering journal 513-516 (2011).
Lee et al., Functional properties of Lactobacillus strains isolated from kimchi, 145 International Journal of Food Microbiology 155-161 (2011).
Siu, Mass of a Bacterium—The Physics Factbook, 1 Page https://hypertextbook.com/facts/2003/LouisSiu.shtml (Apr. 23, 2019).
Kim et al., Heterofermentative Lactic Acid Bacteria Dominate in Korean Commercial Kimchi, 25(2) Food. Sci. Biotechnol. 541-545 (2016).

* cited by examiner

LACTIC ACID BACTERIA CAPABLE OF CONTROLLING BLOOD SUGAR AND USE THEREOF

CROSS-REFERENCE TO RELATED APPLICATION

This application is a Section 371 of International Application No. PCT/KR2016/009995, filed Sep. 7, 2016, which was published in the Korean language on Nov. 30, 2017, under International Publication No. WO 2017/204415 A1, which claims priority under 35 U.S.C. § 119(b) to International Application No. PCT/KR2016/005493, filed May 24, 2016, the disclosures of which are incorporated herein by reference in their entirety.

REFERENCE TO SEQUENCE LISTING SUBMITTED ELECTRONICALLY

This application contains a sequence listing, which is submitted electronically via EFS-Web as an ASCII formatted sequence listing with a file name "Sequence Listing 689288.0012", creation date of Nov. 20, 2018, and having a size of 2.3 MB. The sequence listing submitted via EFS-Web is part of the specification and is herein incorporated by reference in its entirety.

TECHNICAL FIELD

The present invention relates to a novel lactic acid bacterium, and more particularly to, a novel lactic acid bacterium which is isolated from kimchi or human feces and has various functionalities, such as blood sugar control effect, antiobesity effect, blood cholesterol-lowering effect, blood neutral lipid-lowering effect, arteriosclerosis inhibiting effect, immunoregulatory effect, immunopotentiating effect, and inflammation inhibiting effect. The present invention also relates to various uses of novel lactic acid bacteria, and more particularly, to a use of novel lactic acid bacteria for the prevention, alleviation or treatment of diabetes, obesity, a metabolic syndrome, inflammatory diseases and the like.

BACKGROUND ART

As humanity develops into a prosperous society gradually, the lifestyle is rapidly westernized, and the pattern of disease is also changing dramatically. Especially, abdominal obesity, hyperlipidemia, diabetes and hypertension are increasing in modern people. Such diseases are called lifestyle-related diseases in terms of diseases caused by lifestyle changes. Obesity, hyperlipidemia, diabetes, and hypertension among lifestyle-related diseases are known to be important risk factors for cardiovascular diseases, and metabolic syndrome refers to the simultaneous occurrence of these cardiovascular risk factors. In other words, metabolic syndrome refers to a state of high insulin resistance, a high risk of diabetes and cardiovascular disease, and in the presence of metabolic syndrome, the risk of developing cardiovascular disease is more than twice as high, and the risk of developing diabetes increases by more than 10 times. In addition, the prevalence rate of various chronic diseases such as arthritis and cancer is increasing due to increase in lifestyle-related diseases.

The increase in lifestyle-related diseases is largely due to the westernized diet and lack of exercise. Especially, the change of diet leads to changes in the human digestive tract microbiota, which causes the endotoxin produced by the digestive tract microbiota in the digestive tract to increase. Increased endotoxin in the digestive tract causes digestive tract inflammation, increased absorption of endotoxin into the body, and promotes migration of macrophages to adipose tissue and the like, leading to obesity or hyperglycemia. Thus, in case of controlling endotoxins produced by the digestive tract microbiota, blood sugar may be controlled and ultimately improve or treat diabetes.

Diabetes is a typical chronic disease, and is a chronic disease that causes microvascular complications such as retinas, kidneys and nerves, and macrovascular complications such as stroke, angina, myocardial infarction and peripheral vascular disease due to various metabolic disorders including glucose. Diabetes may be treated by drug therapy, exercise therapy, and diet therapy. Depending on the patient's symptoms, insulin medicines and various blood sugar control agents are used. However, diabetes is a complex disease illustrating characteristics such as excessive glucose production in the liver, insulin resistance, and reduced glucose disposal ability in muscle and adipocytes. Therefore, specific treatments alone cannot prevent the occurrence of various side effects. Among them, drug therapy uses insulin and chemicals, there is a constant problem for the side effects of drug use and patient tolerance. Recently, there is a need for studies to prevent, improve, or treat diabetes by using natural products which are dietary and have few side effects in the treatment of diabetes.

In accordance with this trend, researches on the prevention or treatment of abdominal obesity, hyperlipidemia, diabetes, hypertension and the like have been conducted recently using lactic acid bacteria. For example, Korean Patent Registration Publication No. 10-1061219 discloses a pharmaceutical composition for prevention and treatment of diabetes including an artichoke fermented extract fermented with *Lactobacillus* sp. as an active ingredient. In addition, Korean Patent Registration Publication No. 10-1010914 discloses *Lactobacillus plantarum* NUC LG42 strain (accession number: KCCM 10940P) for use in any one selected from the group consisting of body weight and fat reduction, plasma and liver lipid and carnitine improvement, blood leptin, insulin concentration reduction, and memory improvement. In addition, Korean Patent Registration Publication No. 10-1407980 discloses a health functional food for alleviating hyperinsulinemia, hyperglycemia and hypertriglyceridemia containing *Lactobacillus curvatus* HY7601 (accession number: KCTC 11456BP) and *Lactobacillus plantarum* KY1032 (accession number: KCCM10430) as active ingredients characterized by having an effect of reducing the levels of blood insulin, resistin, glucose, C-peptide and triglyceride.

DISCLOSURE

Technical Problem

The present invention has been derived from this conventional background. It is an object of the present invention to provide a novel lactic acid bacterium which may inhibit the proliferation of intestinal microorganisms that secrete endotoxins or inhibit endotoxin production of intestinal microorganisms to regulate blood sugar.

Another object of the present invention is to provide various uses of novel lactic acid bacteria.

Technical Solution

In order to develop an anti-diabetic material having higher safety than synthetic chemicals, the present inventors screened numerous lactic acid bacteria from kimchi or human feces and found that certain *Lactobacillus* species strains could inhibit the proliferation of intestinal microorganisms that secrete endotoxins or inhibit endotoxin production of intestinal microorganisms to regulate blood sugar, and completed the present invention.

In order to achieve one object of the present invention, one embodiment of the present invention is a *Lactobacillus sakei* including a nucleotide sequence as set forth in SEQ ID NO.: 1 as a 16S rDNA, and provides a lactic acid bacterium having blood sugar control activity. The *Lactobacillus sakei* is preferably a *Bacillus* which is positive in Gram strain, and uses ribose, galactose, glucose, fructose, mannose, mannitol, sorbitol, α-methyl-D mannoside, N-acetyl-glucosamine, amygdalin, arbutin, esculin, salicin, cellobiose, maltose, lactose, melibiose, sucrose, trehalose, melezitose, gentiobiose and turanose as a carbon source. In addition, the *Lactobacillus sakei* preferably has one or more activities selected from the group consisting of an anti-obesity activity, a blood cholesterol-lowering activity, a blood neutral lipid-lowering activity, arteriosclerosis-inhibiting activity, a tight junction protein expression inducing activity, an immunoregulatory activity, an immunopotentiating activity, or an inflammation-inhibiting activity in addition to blood sugar control activity. In addition, the *Lactobacillus sakei* is preferably *Lactobacillus sakei* OK67 (accession number: KCCM 11670P). In addition, the *Lactobacillus sakei* preferably inhibits the proliferation of intestinal microorganisms that secrete endotoxins or inhibits endotoxin production of intestinal microorganisms, thereby lowering blood sugar.

In order to achieve another object of the present invention, one embodiment of the present invention provides a composition for lowering blood sugar including *Lactobacillus sakei* including the nucleotide sequence as set forth in SEQ ID NO.: 1 as a 16S rDNA, a culture thereof, a lysate thereof or an extract thereof as an active ingredient. In addition, one embodiment of the present invention provides an anti-obesity composition including *Lactobacillus sakei* including the nucleotide sequence as set forth in SEQ ID NO: 1 as a 16S rDNA, a culture thereof, a lysate thereof, or an extract thereof as an active ingredient. In addition, one embodiment of the present invention provides a pharmaceutical composition for use in the prevention or treatment of diabetes, obesity, hypertriglyceridemia, hypercholesterolemia, hyperlipidemia, dyslipidemia, arteriosclerosis or metabolic syndrome in which at least two of the above diseases occur simultaneously, including *Lactobacillus sakei* including the nucleotide sequence as set forth in SEQ ID NO: 1 as a 16S rDNA, a culture thereof, a lysate thereof, or an extract thereof as an active ingredient. In addition, one embodiment of the present invention provides a food composition for use in the prevention or treatment of diabetes, obesity, hypertriglyceridemia, hypercholesterolemia, hyperlipidemia, dyslipidemia, arteriosclerosis or metabolic syndrome in which at least two of the above diseases occur simultaneously, including *Lactobacillus sakei* including the nucleotide sequence as set forth in SEQ ID NO: 1 as a 16S rDNA, a culture thereof, a lysate thereof, or an extract thereof as an active ingredient.

In order to achieve another object of the present invention, one embodiment of the present invention provides a composition for immune regulation or immune enhancement including *Lactobacillus sakei* including the nucleotide sequence as set forth in SEQ ID NO.: 1 as a 16S rDNA, a culture thereof, a lysate thereof or an extract thereof as an active ingredient.

In addition, one embodiment of the present invention provides a pharmaceutical composition for preventing or treating inflammatory diseases including *Lactobacillus sakei* including the nucleotide sequence as set forth in SEQ ID NO.: 1 as a 16S rDNA, a culture thereof, a lysate thereof or an extract thereof as an active ingredient. In addition, one embodiment of the present invention provides a food composition for preventing or alleviating inflammatory diseases including *Lactobacillus sakei* including the nucleotide sequence as set forth in SEQ ID NO.: 1 as a 16S rDNA, a culture thereof, a lysate thereof or an extract thereof as an active ingredient. At this time, the inflammatory disease is preferably selected from gastritis, gastric ulcer, arthritis, and colitis.

In addition, one embodiment of the present invention provides a pharmaceutical composition for preventing or treating liver damage including *Lactobacillus sakei* including the nucleotide sequence as set forth in SEQ ID NO.: 1 as a 16S rDNA, a culture thereof, a lysate thereof or an extract thereof as an active ingredient. In addition, one embodiment of the present invention provides a food composition for preventing or treating liver damage including *Lactobacillus sakei* including the nucleotide sequence as set forth in SEQ ID NO.: 1 as a 16S rDNA, a culture thereof, a lysate thereof or an extract thereof as an active ingredient. At this time, the liver damage is preferably selected from the group consisting of hepatitis, fatty liver, and liver cirrhosis.

Advantageous Effects

The particular *Lactobacillus* species strain according to the present invention is isolated from kimchi or human feces and has high safety, and has various functionalities, such as excellent blood sugar control activity, anti-obesity activity, blood cholesterol-lowering activity, blood neutral lipid-lowering activity, arteriosclerosis-inhibiting activity, tight junction protein expression-inducing activity, immunoregulatory activity, immunopotentiating activity, and inflammation-inhibiting activity. Therefore, the particular *Lactobacillus* species strain according to the present invention may be used as a food and drug material for preventing, alleviating or treating a metabolic syndrome including diabetes, obesity, fatty liver, glycosuria, hyperlipidemia, cardiovascular disease, hypertension, arteriosclerosis, diabetes or obesity, an inflammatory disease, and the like, or for immune regulation, immune enhancement or inhibition of inflammatory response.

DESCRIPTION OF DRAWINGS

In FIGS. 3 to 17, "LFD" refers to a group fed with a low-fat diet, "LFD-67" refers to a group fed with a low-fat diet and administered *Lactobacillus sakei* OK67 with a dose of 1×10$^9$ CFU/mouse, "HFD" refers to a group fed with a high-fat diet, and "HFD-OK67" refers to a group fed with a high-fat diet and administered *Lactobacillus sakei* OK67 with a dose of 1×10$^9$ CFU/mouse.

In FIGS. 18 and 19, "NOR" refers to a group to which arthritis was not induced by collagen but to which a vehicle was administered, "AC" refers to a group to which arthritis was induced by collagen and a vehicle was administered, and "AO" refers to a group in which arthritis was induced by collagen and *Lactobacillus sakei* OK67 strain was administered together with a vehicle.

In FIGS. 20 to 22, "CIA" refers to collagen-induced arthritis, and "OK 67" refers to *Lactobacillus sakei* OK67 strain.

In FIGS. 23 to 26, "CIA" refers to collagen-induced arthritis, "OK 67" refers to *Lactobacillus sakei* OK67 strain, and "IP" refers to ibuprofen.

DETAILED DESCRIPTION OF EMBODIMENT

Figure 1:
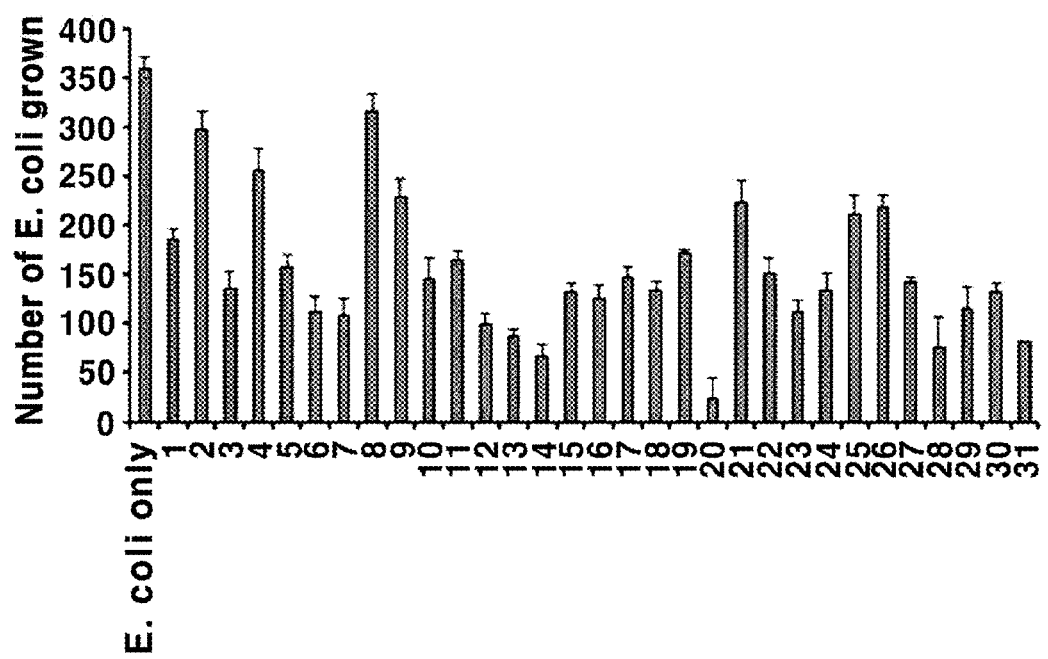
FIG. 1 is a graph illustrating the effect of lactic acid bacteria isolated from cabbage kimchi, radish kimchi, green onion kimchi and human feces on the proliferation of *E. coli*.

Hereinafter, terms used in the present invention will be described.

As used herein, "culture" means a product obtained by culturing a microorganism in a known liquid medium or solid medium, and includes a microorganism.

The terms "pharmaceutically acceptable" and "sitologically acceptable" in the present invention is meant not significantly irritating the organism and not interfering with the biological activity and properties of the administered active substance.

As used herein, the term "prevention" refers to any action that inhibits the symptoms of a particular disease or delays progression upon administration of the composition of the present invention.

As used herein, the term "treatment" refers to any action that improves or beneficially changes the symptoms of a particular disease upon administration of the composition of the present invention.

As used herein, the term "improvement" refers to any action that at least reduces the parameter associated with the condition being treated, for example, the degree of symptoms.

As used herein, the term "administration" is meant to provide any desired composition of the present invention to a subject by any suitable method. Herein, the term "subject" means any animal such as a human, a monkey, a dog, a goat, a pig, or a mouse having a disease in which symptoms of a specific disease can be improved by administering the composition of the present invention.

As used herein, the term "pharmaceutically effective amount" means an amount sufficient to treat a disease at a reasonable benefit or risk rate applicable to medical treatment, which is determined by the type of disease of a subject, severity, activity of drugs, sensitivity to drugs, the time of administration, the route of administration and the rate of excretion, the duration of treatment, and factors including drugs used simultaneously and other factors well known in the medical fields.

Hereinafter, the present invention will be described in detail.

One aspect of the present invention relates to a novel lactic acid bacterium having a blood sugar control activity (for example, hypoglycemic activity).

The novel lactic acid bacterium according to one embodiment of the present invention is *Lactobacillus sakei* including the nucleotide sequence as set forth in SEQ ID NO: 1 as a 16S rDNA and having a blood sugar control activity. The *Lactobacillus sakei* is preferably a *Bacillus* which is positive in Gram strain, and uses ribose, galactose, glucose, fructose, mannose, mannitol, sorbitol, α-methyl-D mannoside, N-acetyl-glucosamine, amygdalin, arbutin, esculin, salicin, cellobiose, maltose, lactose, melibiose, sucrose, trehalose, melezitose, gentiobiose and turanose as a carbon source. In addition, the *Lactobacillus sakei* preferably has one or more activities selected from the group consisting of an anti-obesity activity, a blood cholesterol-lowering activity, a blood neutral lipid-lowering activity, arteriosclerosis-inhibiting activity, or an inflammation-inhibiting activity in addition to blood sugar control activity. In addition, the *Lactobacillus sakei* is preferably *Lactobacillus sakei* OK67 (accession number: KCCM 11670P). In addition, the *Lactobacillus sakei* preferably inhibits the proliferation of intestinal microorganisms that secrete endotoxins or inhibits endotoxin production of intestinal microorganisms, thereby lowering blood sugar. In addition, the *Lactobacillus* species strain of the present invention may be isolated from kimchi. For example, *Lactobacillus sakei* OK67 was isolated from radish kimchi. In addition, the *Lactobacillus* species strain of the present invention preferably has the nucleotide sequence as set forth in SEQ ID NO: 2 as a whole genome sequence.

Another aspect of the invention relates to various uses of the novel lactic acid bacteria. For example, the present invention provides a composition for lowering blood sugar including *Lactobacillus sakei* including the nucleotide sequence as set forth in SEQ ID NO.: 1 as a 16S rDNA, a culture thereof, a lysate thereof or an extract thereof as an active ingredient, as described as a use of the novel lactic acid bacteria. In addition, the present invention provides an anti-obesity composition including *Lactobacillus sakei* including the nucleotide sequence as set forth in SEQ ID NO: 1 as a 16S rDNA, a culture thereof, a lysate thereof, or an extract thereof as an active ingredient, as described as a use of the novel lactic acid bacteria. In addition, the present invention provides a pharmaceutical composition for use in the prevention or treatment of diabetes, obesity, hypertriglyceridemia, hypercholesterolemia, hyperlipidemia, dyslipidemia, arteriosclerosis or metabolic syndrome in which at least two of the above diseases occur simultaneously, including *Lactobacillus sakei* including the nucleotide sequence as set forth in SEQ ID NO: 1 as a 16S rDNA, a culture thereof, a lysate thereof, or an extract thereof as an active ingredient, as described as a use of the novel lactic acid bacteria. In addition, the present invention provides a food composition for use in the prevention or alleviation of diabetes, obesity, hypertriglyceridemia, hypercholesterolemia, hyperlipidemia, dyslipidemia, arteriosclerosis or metabolic syndrome in which at least two of the above diseases occur simultaneously, including *Lactobacillus sakei* including the nucleotide sequence as set forth in SEQ ID NO: 1 as a 16S rDNA, a culture thereof, a lysate thereof, or an extract thereof as an active ingredient, as described as a use of the novel lactic acid bacteria. At this time, the metabolic syndrome refers to a disease in which various metabolic diseases such as diabetes and obesity occur simultaneously in one person, and narrowly refers to a lipid-related metabolic syndrome. In the present invention, the metabolic syndrome is preferably a disease in which one or more diseases selected from the group consisting of diabetes and obesity and one or more diseases selected from the group consisting of hypertriglyceridemia, hypercholesterolemia, hyperlipidemia, dyslipidemia, cardiovascular disease, hypertension, and arteriosclerosis occur simultaneously. In addition, the present invention provides a composition for immune regulation or immune enhancement including *Lactobacillus sakei* including the nucleotide sequence as set forth in SEQ ID NO.: 1 as a 16S rDNA, a culture thereof, a lysate thereof or an extract thereof as an active ingredient, as described as a use of the novel lactic acid bacteria. The *Lactobacillus sakei* OK67 strain according to the present invention may regulate the immunity by restoring the balance of Th17/Treg cells, and thus may improve allergic diseases such as autoimmune diseases such as rheumatoid arthritis, and atopic dermatitis, and may boost the weakened level of immunity. In addition, the present invention provides a pharmaceutical composition for preventing, alleviating or treating inflammatory diseases including *Lactobacillus sakei* including the nucleotide sequence as set forth in SEQ ID NO.: 1 as a 16S rDNA, a culture thereof, a lysate thereof or an extract thereof as an active ingredient, as described as a use of the novel lactic acid bacteria. At this time, the inflammatory disease is not greatly limited to its type as long as it is a disease caused by the inflammatory reaction, and is preferably selected from the group consisting of gastritis, gastric ulcer, arthritis, and colitis. In addition, the present invention provides a composition for preventing, alleviating or treating liver damage including *Lactobacillus sakei* including the nucleotide sequence as set forth in SEQ ID NO.: 1 as a 16S rDNA, a culture thereof, a lysate thereof or an extract thereof as an active ingredient, as described as a use of the novel lactic acid bacteria. In this case, the liver damage refers to a state in which the liver function is not normal due to an external factor or an internal factor and is preferably selected from the group consisting of hepatitis, fatty liver, and cirrhosis. In addition, the hepatitis includes both non-alcoholic hepatitis and alcoholic hepatitis. In addition, the fatty liver includes both non-alcoholic fatty acid and alcoholic fatty acid. In the present invention, a culture of lactic acid bacteria is a product obtained by culturing a *Lactobacillus* species strain in a medium. The culture medium may be selected from known liquid culture media or solid culture media, for example, an MRS liquid medium, an MRS agar medium, a BL agar medium. In the present invention, the composition may be specified to a pharmaceutical composition, a food additive, a food composition (in particular, a functional food composition), or a feed additive depending on the purpose of uses and aspects, and the contents of specific *Lactobacillus* species, which is an active ingredient in a composition, may be adjusted in various ranges depending on the specific form of the composition, the purpose of uses and aspects.

The content of the novel lactic acid bacterium, the culture thereof, the lysate thereof or the extract thereof as an active ingredient in the pharmaceutical composition according to the present invention is not particularly limited and may be, for example, 0.01 to 99% by weight, preferably 0.5 to 50% by weight, more preferably 1 to 30% by weight based on the total weight of the composition. In addition, the pharmaceutical composition according to the present invention may further include, in addition to the active ingredient, an additive such as a pharmaceutically acceptable carrier, excipient or diluent. Examples of carriers, excipients and diluents that may be included in the pharmaceutical composition of the present invention include lactose, dextrose, sucrose, sorbitol, mannitol, xylitol, erythritol, maltitol, starch, acacia rubber, alginate, gelatin, calcium phosphate, calcium silicate, cellulose, methylcellulose, microcrystalline cellulose, polyvinylpyrrolidone, water, methylhydroxybenzoate, propylhydroxybenzoate, talc, magnesium stearate and mineral oil. The pharmaceutical composition of the present invention may further include one or more kinds of known active ingredients effective in preventing or treating diabetes, obesity, fatty liver, hyperlipidemia, cardiovascular disease, hypertension, arteriosclerosis, metabolic syndrome, inflammatory disease or immunodeficiency disease, in addition to a novel lactic acid bacterium, a culture thereof, a lysate thereof or an extract thereof. The pharmaceutical composition of the present invention may be formulated into a formulation for oral administration or parenteral administration by a conventional method, and in case of a preparation, it may be prepared using diluents or excipients such as fillers, extenders, binders, wetting agents, disintegrants, and surfactants which are usually used. Solid preparations for oral administration include tablets, pills, powders, granules, capsules and the like, which may be prepared by mixing at least one excipient such as starch, calcium carbonate, sucrose, lactose, gelatin with an active ingredient. In addition to simple excipients, lubricants such as magnesium stearate and talc may also be used. Liquid preparations for oral administration include suspensions, oral solutions, emulsions and syrups. Various excipients such as wetting agents, sweetening agents, flavor agents, and preservatives may be included in addition to water and liquid paraffin, which are simple diluents commonly used. Preparations for parenteral administration may include sterile aqueous solutions, non-aqueous solutions, suspensions, emulsions, lyophilized preparations, and suppositories. As for the non-aqueous solvent and the suspending solvent, propylene glycol, polyethylene glycol, vegetable oil such as olive oil, injectable ester such as ethyl oleate may be used. As the base of suppositories, witepsol, macrogol, tween 61, cacao paper, laurinum, glycerogelatin and the like may be used. Further, it may be preferably prepared according to each disease or ingredient using a suitable method in the pertinent field or a method described in Remington's Pharmaceutical Science (recent edition), Mack Publishing Company, Easton Pa. The pharmaceutical composition of the present invention may be administered orally or parenterally to a mammal including a human according to a desired method. Examples of the parenteral administration include external dermal application, intraperitoneal injection, rectal injection, subcutaneous injection, intravenous injection, intramuscular injection or intra-thoracic injection. The dosage of the pharmaceutical composition of the present invention is not greatly limited as long as it is a pharmaceutically effective amount, and the range may vary depending on the patient's body weight, age, sex, health condition, diet, administration time, administration method, excretion rate, and severity of a disease. The typical daily dose of the pharmaceutical composition of the present invention is not greatly limited, but is preferably 0.1 to 3000 mg/kg, more preferably 1 to 2000 mg/kg, based on the active ingredient, and may be administered once a day or several times a day.

In addition, the content of the novel lactic acid bacteria, the culture thereof, the lysate thereof or the extract thereof as an active ingredient in the food composition according to the present invention is 0.01 to 50% by weight, preferably 0.1 to 25% by weight, and more preferably 0.5 to 10% by weight based on the total weight of the composition, but is not limited thereto. The food composition of the present invention may be in the form of a pill, a powder, a granule, an infusion, a tablet, a capsule, or a liquid. Specific examples of the food include meat, sausage, bread, chocolate, candy, snack, confectionery, pizza, ramen, other noodles, gums, dairy products including ice cream, various soups, beverages, tea, functional water, drinks, alcoholic beverages and vitamin complexes, and include all the healthy foods in a common sense. The food composition of the present invention may include, in addition to the active ingredient, a sitologically acceptable carrier, various flavors or natural carbohydrates as an additional ingredient. In addition, the food composition of the present invention may include various nutrients, vitamins, electrolytes, flavors, colorants, pectic acids and its salts, alginic acid and its salts, organic acids, protective colloid thickeners, pH adjusters, stabilizers, preservatives, glycerin, alcohols, a carbonating agent used in a carbonated drink, and the like. In addition, the food composition of the present invention may include fruit flesh for the production of natural fruit juices, fruit juice drinks and vegetable drinks. These ingredients may be used independently or in combination. The above-mentioned natural carbohydrates are sugar alcohols such as monosaccharides such as glucose and fructose, disaccharides such as maltose and sucrose, polysaccharides such as dextrin and cyclodextrin, and xylitol, sorbitol and erythritol. Natural flavors such as thaumatin and *stevia* extract, synthetic flavors such as saccharin and aspartame may be used as the flavor agent.

Hereinafter, the present invention will be described in more detail with reference to examples. However, the following examples are intended to clearly illustrate the technical features of the present invention and do not limit the scope of protection of the present invention.

1. Isolation and Identification of Lactic Acid Bacteria (1) Isolation of Lactic Acid Bacteria from Kimchi Cabbage kimchi, radish kimchi, and green onion kimchi were each crushed and the crushed liquid was suspended in an MRS liquid medium (MRS Broth; Difco, USA). Then, the supernatant was taken to be inoculated into MRS agar medium (Difco, USA) and was anaerobically incubated at 37° C. for about 48 hours. Then, colony-forming strains were isolated.

(2) Isolation of Lactic Acid Bacteria from Human Feces

Human feces were put in a GAM liquid medium (GAM broth; Nissui Pharmaceutical, Japan) and were suspended. Then, the supernatant was taken to be inoculated into a BL agar medium (Nissui Pharmaceutical, Japan), and was anaerobically incubated at 37° C. for about 48 hours. Then, colony-forming strains were isolated.

(3) Identification of Selected Lactic Acid Bacteria

The physiological characteristics and 16S rDNA sequence of strains isolated from kimchi or human feces were analyzed and the species of the strains were identified and were given strain names. Table 1 below shows the management numbers and the names of the strains of the lactic acid bacteria isolated from cabbage kimchi, radish kimchi, green onion kimchi and human feces. In Table 1 below, the lactic acid bacteria of Management Nos. 1, 3, 5, 7, 9, 11, 13, 17, 20, 22 and 25 were isolated from cabbage kimchi, the lactic acid bacteria of Management Nos. 2, 4, 6, 8, 10, 14, 19 and 21 were isolated from radish kimchi, the lactic acid bacteria of Management Nos. 12, 15 and 18 were isolated from green onion kimchi, and lactic acid bacteria of Management Nos. 24, 26, 27, 28, 29 and 30 were isolated from human feces.

TABLE 1

| Management Nos. | Names of strains |
|---|---|
| 1 | *Leuconostoc mesenteroides* OK1 |
| 2 | *Leuconostoc mesenteroides* OK15 |
| 3 | *Lactobacillus curvatus* OK21 |
| 4 | *Lactobacillus curvatus* OK25 |
| 5 | *Lactobacillus brevis* OK11 |
| 6 | *Lactobacillus brevis* OK12 |
| 7 | *Lactobacillus acidophilus* OK1 |
| 8 | *Lactobacillus acidophilus* OK7 |
| 9 | *Lactobacillus lactis* OK1 |
| 10 | *Lactobacillus lactis* OK2 |
| 11 | *Lactobacillus helveticus* OK1 |
| 12 | *Lactobacillus helveticus* OK2 |
| 13 | *Lactobacillus plantarum* OK23 |
| 14 | *Lactobacillus plantarum* OK32 |
| 15 | *Lactobacillus plantarum* OK36 |
| 16 | *Lactobacillus plantarum* OK37 |
| 17 | *Lactobacillus sakei* OK26 |
| 18 | *Lactobacillus sakei* OK45 |
| 19 | *Lactobacillus sakei* OK67 |
| 20 | *Lactobacillus fermentum* OK19 |
| 21 | *Lactobacillus fermentum* OK21 |
| 22 | *Lactobacillus gasseri* OK1 |
| 23 | *Lactobacillus gasseri* OK2 |
| 24 | *Lactobacillus johnsonii* OK1 |
| 25 | *Lactobacillus johnsonii* OK2 |
| 26 | *Lactobacillus paracasei* OK2 |
| 27 | *Lactobacillus paracasei* OK9 |
| 28 | *Lactobacillus reuteri* OK1 |
| 29 | *Lactobacillus ruminis* OK1 |
| 30 | *Lactobacillus ruminis* OK17 |

Among the strains listed in Table 1 above, *Lactobacillus sakei* OK67 is an anaerobic bacterium that is positive in Gram strain, and the carbon source availability among physiological characteristics is as shown in Table 2 below. In Table 2 below, the carbon source availability of *Lactobacillus sakei* OK67 was analyzed by sugar fermentation test using API Kit (model name: API 50 CHL; manufacturer: BioMerieux's, USA). In addition, in the following table, "+" represents the case where the carbon source availability is positive, "−" represents the case where the carbon source availability is negative, "±" represents the case where the carbon source availability is ambiguous, and the blank represents the non-measurement.

TABLE 2

| | Name of strains | | |
|---|---|---|---|
| Carbon source | *Lactobacillus sakei* OK67 | DSM20017 (ATCC15521)[a] | *Lactobacillus sakei* K-7[b] |
|---|---|---|---|
| glycerol | − | | |
| erythritol | ± | | |
| D-arabinose | ± | | |
| L-arabinose | − | + | − |
| D-ribose | + | + | |
| D-xylose | − | | |
| L-xylose | − | − | |
| adonitol | − | | |
| methyl-BD-xylopyranosicle | − | | |
| D-galactose | + | + | − |
| D-glucose | + | + | |
| D-fructose | + | + | |
| D-mannose | + | + | |
| L-sorbose | − | | |
| rhamnose | − | − | |
| dulcitol | − | | |
| inositol | − | | |
| mannitol | + | | |
| sorbitol | + | | |
| α-methyl-D-mannoside | + | | |
| α-methyl-D-glucoside | − | − | |
| N-acetyl-glucosamine | + | + | |
| amygdalin | + | | |
| arbutin | + | − | |
| esculin | + | + | |
| salicin | + | + | |
| cellobiose | + | − | |
| maltose | + | + | ± |
| lactose | + | − | |
| melibiose | + | + | |
| sucrose | + | + | + |
| trehalose | + | + | |
| inulin | − | | |
| melezitose | + | | |
| raffinose | − | | |
| starch | − | | |
| glycogen | − | | |
| xylitol | − | ± | |
| gentiobiose | + | | |
| D-turanose | + | | |
| D-lyxose | − | | |
| D-tagatose | − | | |
| D-fucose | − | | |
| L-fucose | − | | |
| D-arabitol | − | | |
| L-arabitol | − | | |
| gluconate | ± | ± | |
| 2-keto-gluconate | − | | |
| 5-keto-gluconate | − | | |

[a] McLeod et al., Diversity of *Lactobacillus* strains investigated by phenotypic and genotypic methods. Systematic and applied microbiology 2008; 31: 393-403.
[b] Moon et al., Anticariogenic activities of *Lactobacillus sakei* K-7 isolated from kimchi. Korean society for biotechnology and bioengineering journal 2011; 26: 513-516.

In addition, 16S rDNA was measured as a chemotaxonomical characteristic of *Lactobacillus sakei* OK67, and as a result, it was found to have the nucleotide sequence as set forth in SEQ ID NO: 1. The 16S rDNA nucleotide sequence of *Lactobacillus sakei* OK67 was identified by BLAST search of Genebank (http://www.ncbi.nlm.nih.gov/). As a result, *Lactobacillus sakei* (*Lactobacillus sakei*) strain having the same 16S rDNA nucleotide sequence was not detected and showed 99% homology with 16S rDNA partial sequence of *Lactobacillus sakei* NBRC 15893 (NCBI ACCESSION: NR 113821).

2. Selection of Lactic Acid Bacteria Inhibiting the Proliferation of *E. coli* Producing Endotoxin (1) Experimental Method Any one selected from *E. coli* cultured in a TSB (tryptic soy broth) medium in advance and lactic acid bacteria isolated from cabbage kimchi, radish kimchi, green opinion kimchi and human feces was inoculated into a TSB (tryptic soy broth) medium all together in an amount of $1 \times 10^5$ CFU and $1 \times 10^5$ CFU, respectively, and cultured at 37° C. for about 24 hours. Thereafter, a mixed strain culture medium of *E. coli* and lactic acid bacteria was diluted $10^6$ times, and 0.1 ml of the diluted culture medium was inoculated into a DHL medium and cultured at 37° C. for about 24 hours. Thereafter, the number of *E. coli* in the final culture solution was measured. As a control group, *E. coli* alone was inoculated into a TSB (tryptic soy broth) medium in an amount of $1 \times 10^5$ CFU and cultured instead of mixed bacteria of *E. coli* and lactic acid bacteria, and then the number of *E. coli* in the final culture solution was measured by going through the same process.

(2) Measurement Result

FIG. 1 is a graph illustrating the effect of lactic acid bacteria isolated from cabbage kimchi, radish kimchi, green onion kimchi, and human feces on the proliferation of *E. coli*. As illustrated in FIG. 1, *Lactobacillus sakei* OK67 exhibited the best ability to inhibit the proliferation of *E. coli*, followed by *Lactobacillus plantarum* OK23, *Lactobacillus parasakei* OK9, and *Lactobacillus ruminis* OK17.

3. Selection of Lactic Acid Bacteria that Inhibit Endotoxin Production in the Digestive Tract Microflora (1) Experimental Method The intestinal flora that were cultured in a GAM liquid medium (GAM broth; Nissui Pharmaceutical, Japan) in advance, and any one selected from the lactic acid bacteria which showed excellent ability to inhibit the proliferation of *E. Coli* [*Lactobacillus sakei* OK67, *Lactobacillus plantarum* OK23, *Lactobacillus paracasei* OK9 and *Lactobacillus ruminis* OK17] were inoculated into a GAM liquid medium (GAM broth; Nissui Pharmaceutical Japan), which is an anaerobic medium, in an amount of $1 \times 10^8$ CFU and $1 \times 10^5$ CFU, respectively, and cultured anaerobically at 37° C. for about 24 hours. Thereafter, the culture solution was treated with ultrasonic waves for about 1 hour to destroy the extracellular membrane of the bacteria, and centrifuged under the condition of 5000×g to obtain a supernatant. Thereafter, the content of LPS (lipopolysaccharide), which is a typical endotoxin present in the supernatant, was measured by LAL (Limulus Amoebocyte Lysate) assay kit (manufacturer: Cape Cod Inc., USA). As a control group, the intestinal flora was inoculated into a GAM liquid medium (GAM broth; Nissui Pharmaceutical, Japan), an anaerobic medium in an amount of $1 \times 10^8$ CFU and cultured instead of mixed bacteria of internal flora and lactic acid bacteria, and then the content of LPS (lipopolysaccharide) present in the supernatant was measured by going through the same process.

(2) Measurement Result

Figure 2:
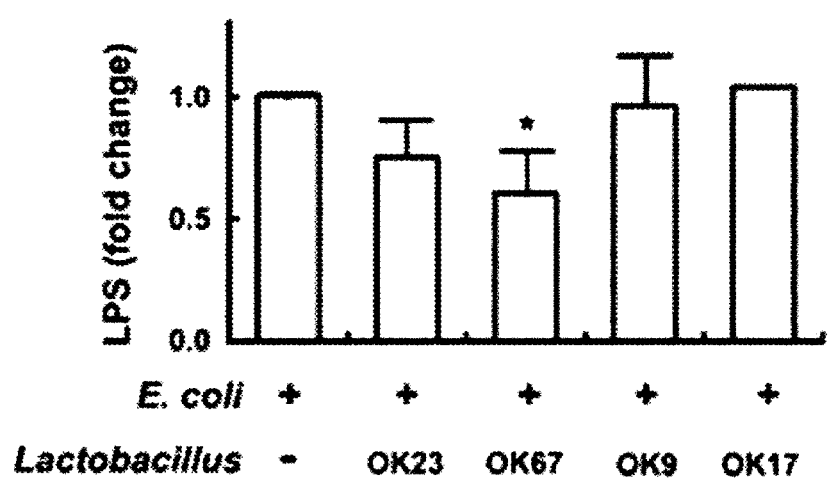
FIG. 2 is a graph illustrating the effect of lactic acid bacteria having excellent ability to inhibit the proliferation of *E. coli* [*Lactobacillus sakei* OK67, *Lactobacillus plantarum* OK23, *Lactobacillus parasakei* OK9, *Lactobacillus ruminis* OK17] on the production of endotoxin in intestinal flora.

FIG. 2 is a graph illustrating the effect of lactic acid bacteria having excellent ability to inhibit the proliferation of *E. coli* [*Lactobacillus sakei* OK67, *Lactobacillus plantarum* OK23, *Lactobacillus parasakei* OK9, *Lactobacillus ruminis* OK17] on the production of endotoxin in intestinal flora. In FIG. 2, the content of LPS (lipopolysaccharide) is shown as a relative multiple of the control group. As illustrated in FIG. 2, just like the result of the ability to inhibit the proliferation of *E. coli*, the ability of intestinal flora to inhibit endotoxin production was the most superior in *Lactobacillus sakei* OK67, followed by *Lactobacillus plantarum* OK23, *Lactobacillus parasakei* OK9, and *Lactobacillus ruminis* OK17.

4. In-Vivo Experiments on the Hypoglycemic Effect of Lactic Acid Bacteria (1) Experimental Method A total of 28 mice of 5-week-old male C57BL/6J were divided into two groups. Low-fat diet (product model name: D12450B; supplier: Research Diets, Inc., New Brunswick, N.J.) in which 10% of the total calorie is fat was administered for 4 weeks in a low-fat diet group (n=14), and high-fat diet (product model: D12492; supplier: Research Diets, Inc., New Brunswick, N.J.) in which 60% of the total calorie is fat was administered for 4 weeks in a high-fat diet group (n=14). Thereafter, the low-fat diet group was divided into two groups (LFD, LFD-67) by 7 mice each. The LFD group was administered low-fat diet and saline solution was administered orally daily for 4.5 weeks (31 days). *Lactobacillus sakei* OK67 strain was orally administered at a daily dose of $1 \times 10^9$ CFU for 4.5 weeks (31 days) at the time of administering low-fat diet to the LFD-67 group, and the experiment was terminated the next day. In addition, the high-fat diet group was divided into two groups (HFD, HFD-67) by 7 mice each. The HLFD group was administered high-fat diet and saline solution was administered orally daily for 4.5 weeks (31 days). *Lactobacillus sakei* OK67 strain was orally administered at a daily dose of $1 \times 10^9$ CFU for 4.5 weeks (31 days) at the time of administering high-fat diet to the HFD-67 group, and the experiment was terminated the next day. The number of oral administration of *Lactobacillus sakei* OK67 strain was 6 days on a basis of one week. During the experimental period, the mice were raised in a breeding environment at a temperature of 20±2° C., a humidity of 50±5% and a light-dark cycle of 12 hours. The content of blood sugar, plasma insulin, plasma endotoxin and fecal endotoxin was measured at the end of the experiment and the oral glucose tolerance test was performed 5 days before the end of the experiment.

Figure 3:
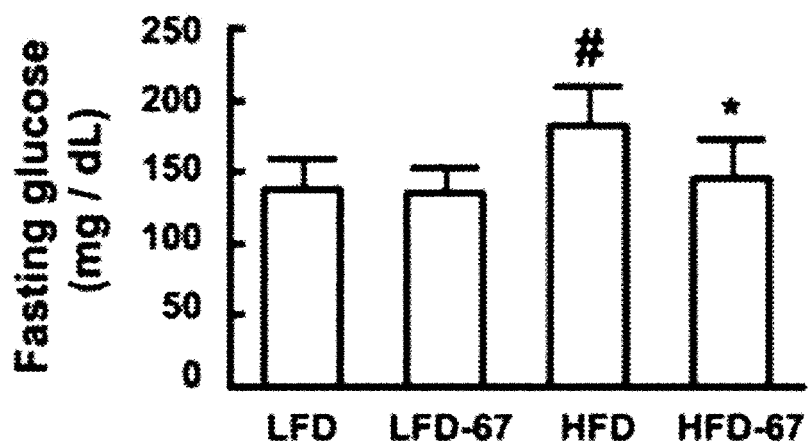
FIG. 3 is a graph illustrating the effect of *Lactobacillus sakei* OK67 on the blood sugar level of a model animal in which obesity was induced by a high-fat diet by experimental groups.

(2) Measurement of Blood Sugar, Plasma Insulin, Plasma Endotoxin and Fecal Endotoxin Content About 0.5 µl of blood was collected from the tail end of the mice and the blood sugar was measured using a kit for measuring glucose (manufacturer: ASAN PHARM. CO. LTD., Korea). FIG. 3 is a graph illustrating the effect of *Lactobacillus sakei* OK67 on the blood sugar level of a model animal in which obesity was induced by a high-fat diet by experimental groups. As illustrated in FIG. 3, the level of blood sugar of a group administered *Lactobacillus sakei* OK67 strain with a high-fat diet were significantly lower than that fed with high-fat diets alone.

Figure 4:
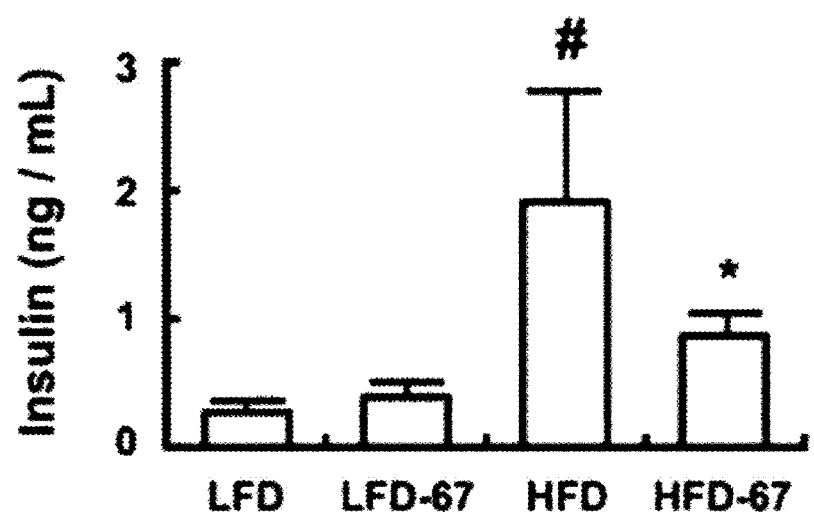
FIG. 4 is a graph illustrating the effect of *Lactobacillus sakei* OK67 on the plasma insulin level of a model animal in which obesity was induced by a high-fat diet by experimental groups.

Plasma insulin was measured using a mouse insulin ELISA kit (LINCO Research, St. Charles, Mo.). FIG. 4 is a graph illustrating the effect of *Lactobacillus sakei* OK67 on the plasma insulin level of a model animal in which obesity was induced by a high-fat diet by experimental groups. As illustrated in FIG. 4, the plasma insulin content of a group fed with *Lactobacillus sakei* OK67 strain with a high-fat diet was significantly lower than that fed with high-fat diets alone.

Figure 5:
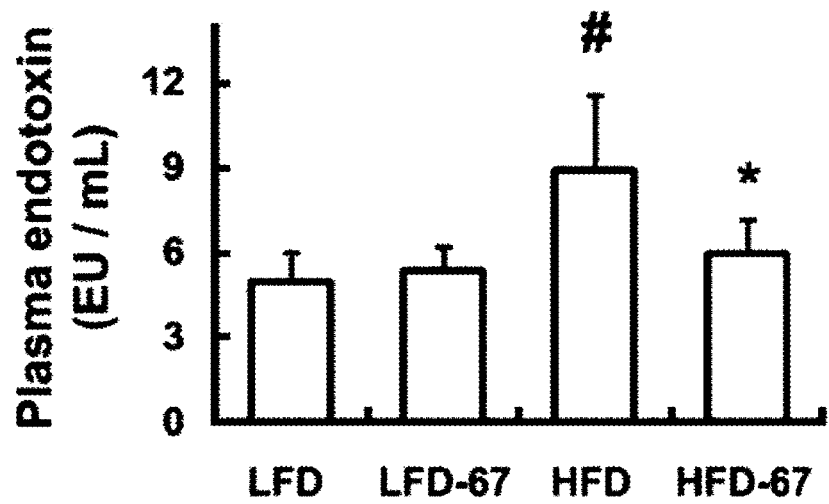
FIG. 5 is a graph illustrating the effect of *Lactobacillus sakei* OK67 on plasma endotoxin content of a model animal in which obesity was induced by a high-fat diet by experimental groups.
Figure 6:
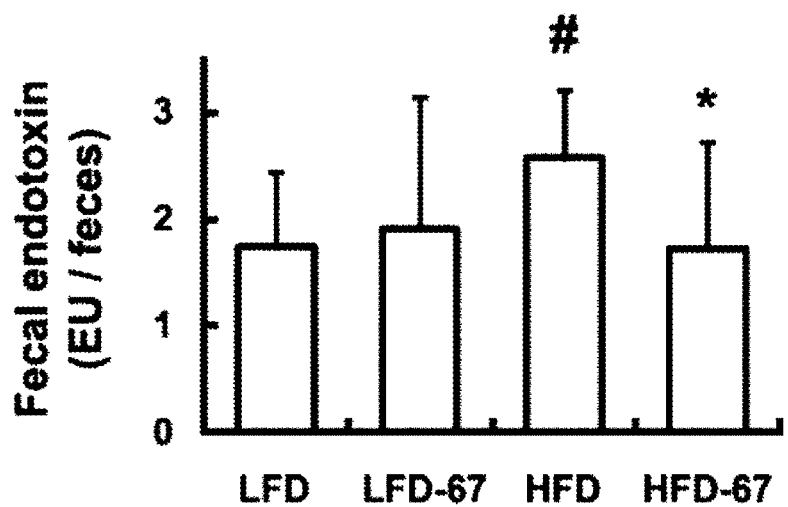
FIG. 6 is a graph illustrating the effect of *Lactobacillus sakei* OK67 on fecal endotoxin content of a model animal in which obesity was induced by a high-fat diet by experimental groups.

FIG. 5 is a graph illustrating the effect of *Lactobacillus sakei* OK67 on plasma endotoxin content of a model animal in which obesity was induced by a high-fat diet by experimental groups, and FIG. 6 is a graph illustrating the effect of Lactobacillus sakei OK67 on fecal endotoxin content of a model animal in which obesity was induced by a high-fat diet by experimental groups. As illustrated in FIGS. 5 and 6, plasma endotoxin content and fecal endotoxin content of a group fed with Lactobacillus sakei OK67 strain with a high-fat diet was significantly lower than that fed with high-fat diets alone.

(3) Oral Glucose Tolerance Test (OGTT)

Five days before the end of the experiment, the experimental animals were fasted for 6 hours, and glucose was orally administered at a volume of 2 g/kg body weight. Then, blood was collected from the tail at 0, 15, 30, 60, 90 and 120 minutes, and glucose concentration was measured. During the oral glucose tolerance test, the experimental animals were given a stable environment and water was allowed to ingest freely. In addition, the area under the glucose-time curve (AUC) was calculated using the following formula.

$$AUC=0.5 \times (0.5 \times C0 + C15 + C30 + C60 + C90 + 0.5 \times C120)$$

In the above formula, C0, C15, C30, C60, C90 and C120 are glucose concentrations measured at 0 minute, 15 minutes, 30 minutes, 60 minutes, 90 minutes and 120 minutes in an orderly manner, respectively.

Figure 7:
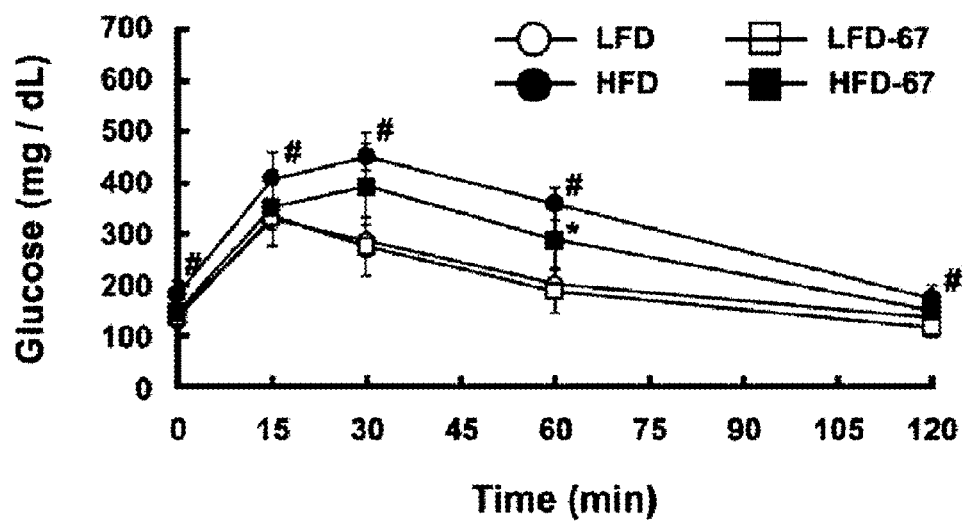
FIG. 7 is a graph illustrating the effect of *Lactobacillus sakei* OK67 on oral glucose tolerance test of a model animal in which obesity was induced by a high-fat diet by experimental groups.
Figure 8:
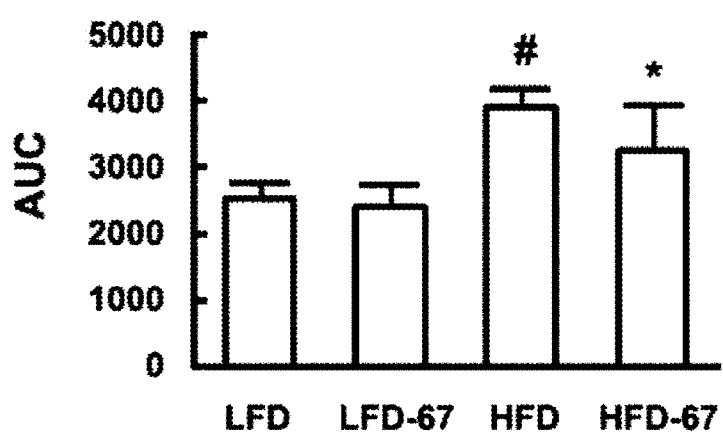
FIG. 8 is a graph illustrating the glucose tolerance test result of FIG. 7 as AUC (area under the glucose-time curve).

FIG. 7 is a graph illustrating the effect of Lactobacillus sakei OK67 on oral glucose tolerance test of a model animal in which obesity was induced by a high-fat diet by experimental groups, and FIG. 8 is a graph illustrating the glucose tolerance test result of FIG. 7 as AUC (area under the glucose-time curve). As illustrated in FIGS. 7 and 8, the AUC of a group fed with Lactobacillus sakei OK67 strain with a high-fat diet was significantly lower than that fed with high-fat diets alone.

5. In-Vivo Experiments on the Anti-Obesity Effect of Lactic Acid Bacteria (1) Experimental Method A total of 28 mice of 5-week-old male C57BL/6J were divided into two groups. Low-fat diet (product model name: D12450B; supplier: Research Diets, Inc., New Brunswick, N.J.) in which 10% of the total calorie is fat was administered for 28 days in a low-fat diet group (n=14), and high-fat diet (product model: D12492; supplier: Research Diets, Inc., New Brunswick, N.J.) in which 60% of the total calorie is fat was administered for 28 days in a high-fat diet group (n=14). Thereafter, the low-fat diet group was divided into two groups (LFD, LFD-67) by 7 mice each. The LFD group was administered low-fat diet and saline solution was administered orally daily for 31 days. Lactobacillus sakei OK67 strain was orally administered at a daily dose of $1 \times 10^9$ CFU for 31 days at the time of administering low-fat diet to the LFD-67 group, and the experiment was terminated the next day. In addition, the high-fat diet group was divided into two groups (HFD, HFD-67) by 7 mice each. The HLFD group was administered high-fat diet and saline solution was administered orally daily for 31 days. Lactobacillus sakei OK67 strain was orally administered at a daily dose of $1 \times 10^9$ CFU for 31 days at the time of administering high-fat diet to the HFD-67 group, and the experiment was terminated the next day. The number of oral administration of Lactobacillus sakei OK67 strain was 6 days on a basis of 7 days. During the experimental period, the mice were raised in a breeding environment at a temperature of 20±2° C., a humidity of 50±5% and a light-dark cycle of 12 hours. After the experiment, the experimental animals were sacrificed by cardiac puncture, and colon and epididymal fat (EF) were extracted and additionally analyzed.

(2) Body Weight Change and Weight Change of Adipose Tissue

Figure 9:
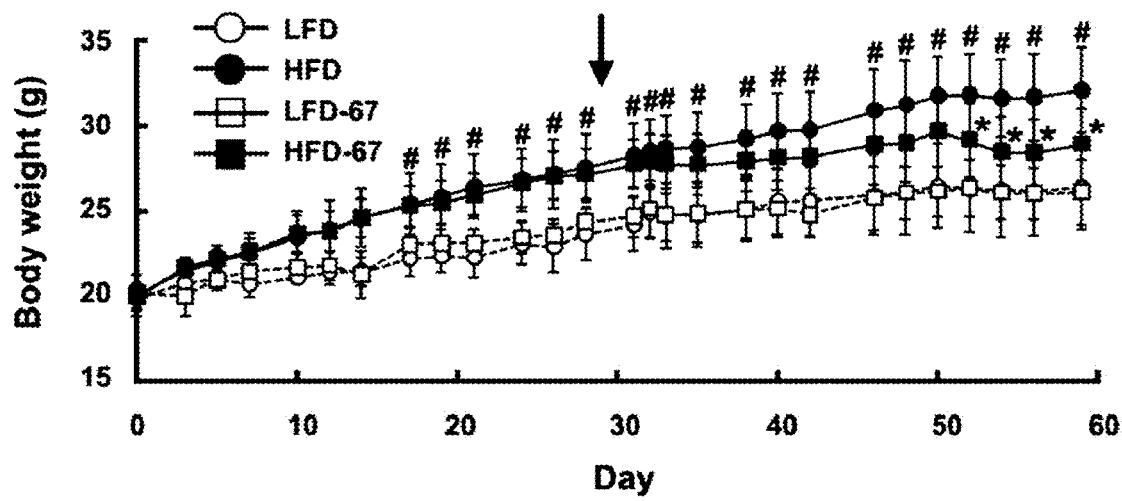
FIG. 9 is a graph illustrating the effect of *Lactobacillus sakei* OK67 on changes in body weight of a model animal in which obesity was induced by a high-fat diet by experimental groups.
Figure 10:
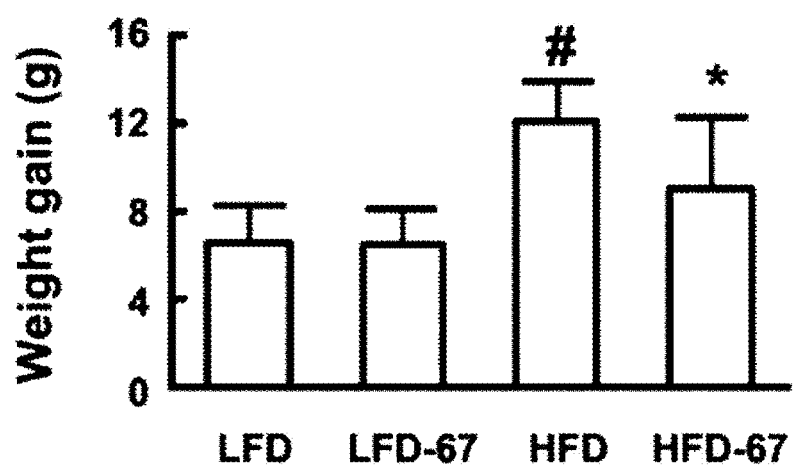
FIG. 10 is a graph illustrating the effect of *Lactobacillus sakei* OK67 on body weight gain of a model animal in which obesity was induced by a high-fat diet by experimental groups.
Figure 11:
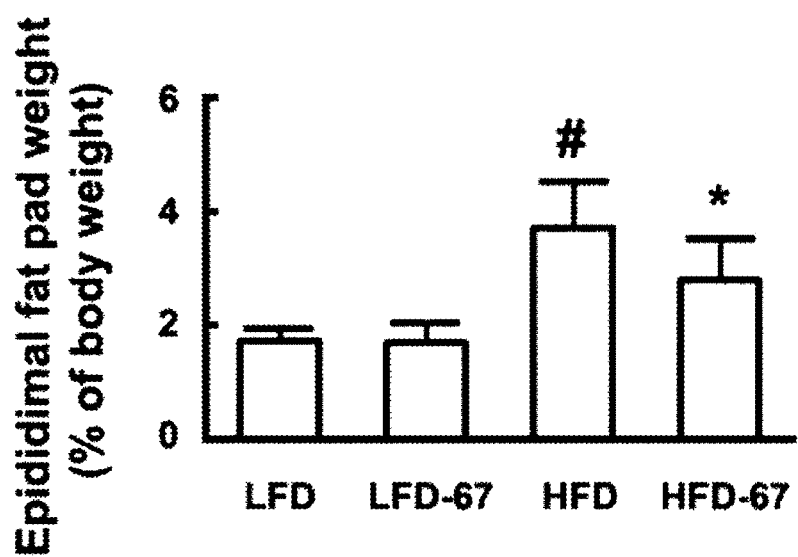
FIG. 11 is a graph illustrating the effect of *Lactobacillus sakei* OK67 on the weight change of epididymal adipose tissue of a model animal in which obesity was induced by a high-fat diet by experimental groups.

FIG. 9 is a graph illustrating the effect of Lactobacillus sakei OK67 on changes in body weight of a model animal in which obesity was induced by a high-fat diet by experimental groups, and FIG. 10 is a graph illustrating the effect of Lactobacillus sakei OK67 on weight gain a model animal in which obesity was induced by a high-fat diet by experimental groups. The arrow in the downward direction in FIG. 9 represents the time when Lactobacillus sakei OK67 was orally administered. In addition, FIG. 11 is a graph illustrating the effect of Lactobacillus sakei OK67 on the weight change of epididymal adipose tissue of a model animal in which obesity was induced by a high-fat diet by experimental groups. As illustrated in FIGS. 9 to 11, in the group to which Lactobacillus sakei OK67 strain was orally administered together with the high-fat diet after induction of obesity, the body weight was significantly reduced compared with the group fed only with high-fat diets after induction of obesity, and the weight of adipose tissue was shown to be far lower.

(3) Measurement of Plasma Triglyceride, Plasma Total Cholesterol and Plasma HDL Cholesterol Content Plasma triglyceride, plasma cholesterol and plasma HDL content of the experimental animals that induced obesity and received lactic acid bacteria for 35 days were measured as follows.

Plasma triglyceride was measured using a kit for measuring triglyceride (ASAN PHARM. CO. LTD., Korea). 1.5 ml of the enzyme solution and 10 μl of plasma were added to the test tube, followed by stirring. Thereafter, the sample was heated in a water bath at 37° C. for 10 minutes with a standard solution having a triglyceride content of 0, 75, 150, 225 and 300 mg/dl, respectively, and the absorbance at 550 nm was measured and quantified by colorimetry. In addition, plasma total cholesterol was measured using a kit for total cholesterol measurement (ASAN PHARM. CO. LTD., Korea). 1.5 ml of the enzyme solution and 10 μl of plasma were added to the test tube, followed by stirring. Thereafter, the sample was heated in a water bath at 37° C. for 10 minutes with a standard solution having a total cholesterol content of 0, 75, 150, 225 and 300 mg/dl, respectively, and the absorbance at 550 nm was measured and quantified by colorimetry. In addition, plasma HDL cholesterol was measured using a kit for HDL cholesterol measurement (ASAN PHARM. CO. LTD., Korea). After adding 50 μl of needle-shaped reagent to 50 μl of plasma, the mixture was stirred, left at room temperature for 10 minutes, and then centrifuged at 3000 rpm for 10 minutes to obtain 25 μl of the supernatant. Then, 750 μl of the enzyme solution was added to the supernatant, and the mixture was stirred. Thereafter, the sample was heated in a water bath at 37° C. for 5 minutes with a standard solution having an HDL cholesterol content of 0, 10, 20, 30, 40 and 50 ml/dl, respectively, and the absorbance at 500 nm was measured and quantified by colorimetry.

In addition, the atherogenic index of plasma was calculated by the following equation.

$$\text{Atherogenic index} = (\text{total cholesterol} - \text{HDL cholesterol})/\text{HDL cholesterol}$$

Figure 12:
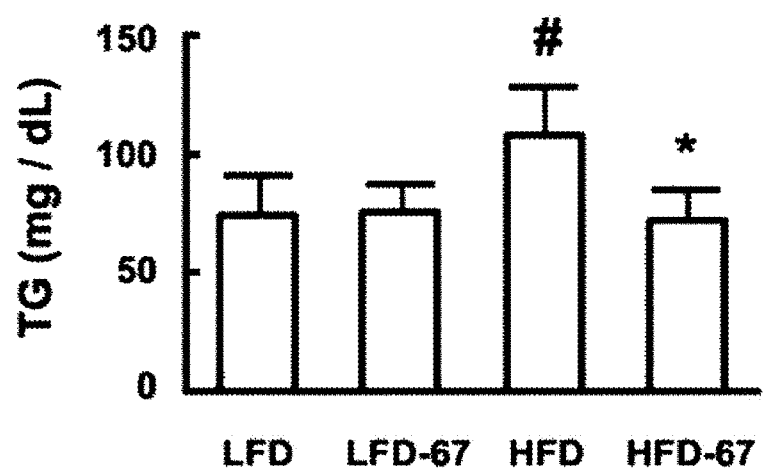
FIG. 12 illustrates the results of measurement of plasma total triglyceride content by experimental group.
Figure 13:
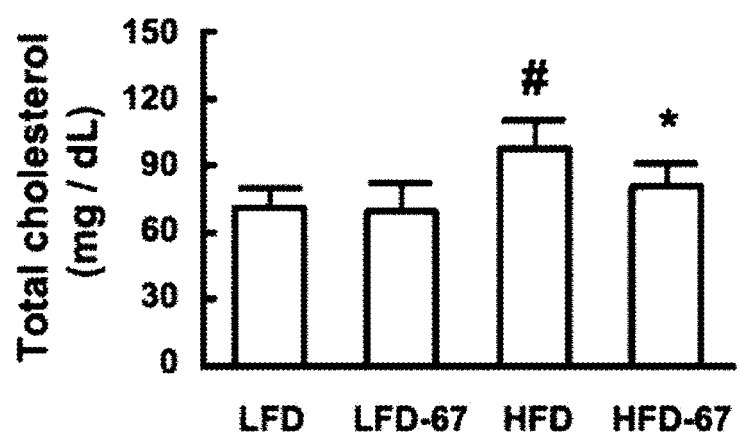
FIG. 13 illustrates the results of measurement of total cholesterol content by experimental group.
Figure 14:
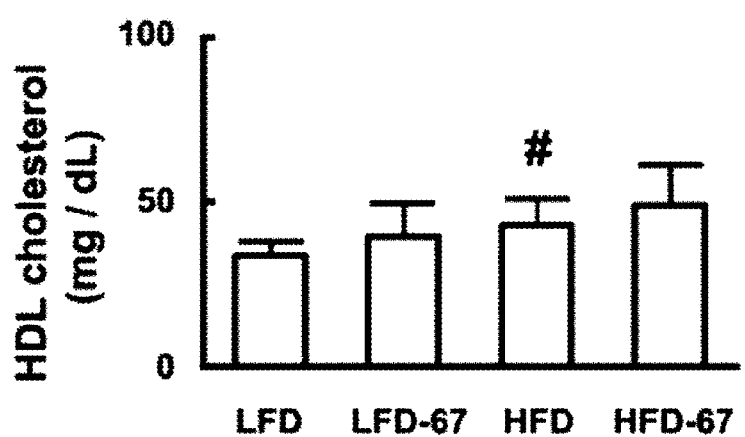
FIG. 14 illustrates the results of HDL cholesterol content measurement by experimental group.
Figure 15:
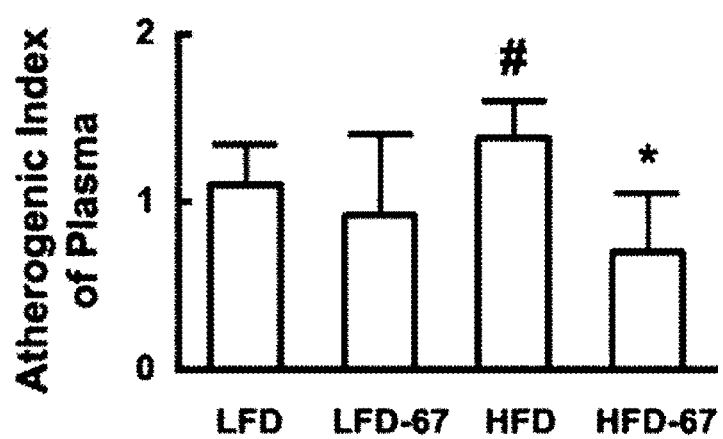
FIG. 15 illustrates the results of measurement of arteriosclerosis index by experimental groups.

FIG. 12 illustrates the results of measurement of plasma total triglyceride content by experimental group, FIG. 13 illustrates the results of measurement of total cholesterol content by experimental group, FIG. 14 illustrates the results of HDL cholesterol content measurement by experimental group, FIG. 15 illustrates the results of measurement of arteriosclerosis index by experimental groups. As illustrated in FIGS. 12 to 15, in the group to which *Lactobacillus sakei* OK67 strain was orally administered together with the high-fat diet after induction of obesity, the plasma triglyceride, plasma total cholesterol content and atherogenic index were significantly reduced compared with the group fed only with high-fat diets after induction of obesity, and HDL cholesterol content was increased.

(4) Analysis of Protein Level Change Related to Lipid Metabolism

In order to investigate the effect of high-fat diet feeding and the administration of *Lactobacillus sakei* OK67 on the protein level change related to lipid metabolism, the levels of PPARγ, C/EBPα, FAS and αFABP, which are the adipocyte differentiation factors, and the levels of macrophage markers TNF-α, IL-1β, F4/80 and CD68 in epididymal adipose tissue of experimental animals were measured by Western blotting.

Figure 16:
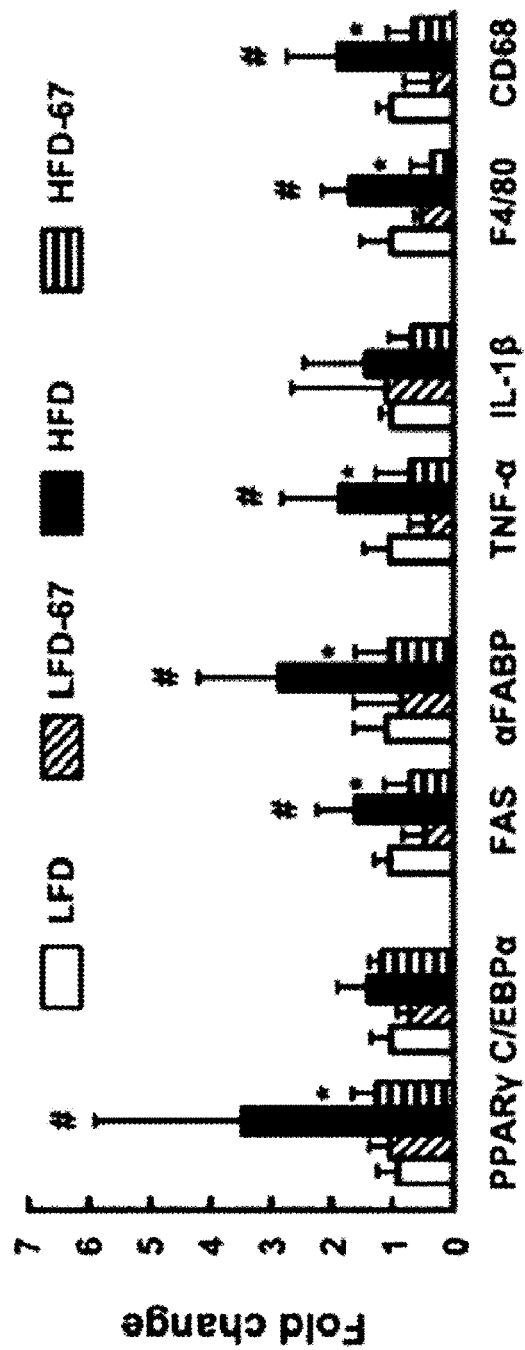
FIG. 16 is a graph illustrating the effect of *Lactobacillus sakei* OK67 on the change of lipid metabolism-related protein level of a model animal in which obesity was induced by a high-fat diet by experimental groups.

Specifically, the epididymal adipose tissue of the experimental animals was homogenized using an RIPA buffer (50 mM Tris-HCl, pH 7.4, 1% NP-40, 0.25% Na-deoxycholate, 150 mM NaCl, 1 mM EDTA) to which protease inhibitor tablet (Roche, USA), phosphatase inhibitor (Roche) and phenylmethanesulfonylfluoride (PMSF) are added, and then centrifuged at 14,000 rpm for 15 minutes to obtain a supernatant. Proteins were isolated from the supernatant by performing 10% SDS-PAGE (sodium dodecyl sulfate-polyacrylamide gel electrophoresis). The isolated protein samples were transferred to a PVDF membrane (Millipore, USA). Thereafter, the sample-transferred PVDF membrane was blocked with 5% skim milk (Difco, France) for 1 hour and 30 minutes in a TBS-T buffer. Then, the primary antibody (Cell Signaling) to PPARγ (peroxisome proliferator-activated receptor-γ), C/EBPα (CCAAT/enhancer-binding protein-α), FAS (fatty acid synthase), αFABP, TNF-α, IL-1β, F4/80, CD68 was added and allowed to react overnight with shaking maintained. Thereafter, after sufficiently washing with TBS-T buffer, the secondary antibody, which is goat anti-rabbit IgG (H+L)-HRP conjugate (BIORAD) was diluted at a ratio of 1:5000 and reacted for 1 hour and 30 minutes. Thereafter, after sufficiently washing with TBS-T buffer and reacting with ECL solution (Clarity western ECL substrate, BIORAD), proteins were detected by chemiluminescence (CLINX science instruments, USA). The density of each band was quantified and the amount of protein expression in the other experimental groups was relatively calculated based on the amount of protein expression in the group fed only with low-fat diets. FIG. 16 is a graph illustrating the effect of *Lactobacillus sakei* OK67 on the change of lipid metabolism-related protein level of a model animal in which obesity was induced by a high-fat diet by experimental groups. As illustrated in FIG. 16, adipocyte differentiation factors and macrophage markers in the epididymal adipose tissue of experimental animals were significantly increased by high-fat diet, but they were significantly decreased by administration of *Lactobacillus sakei* OK67.

Figure 17:
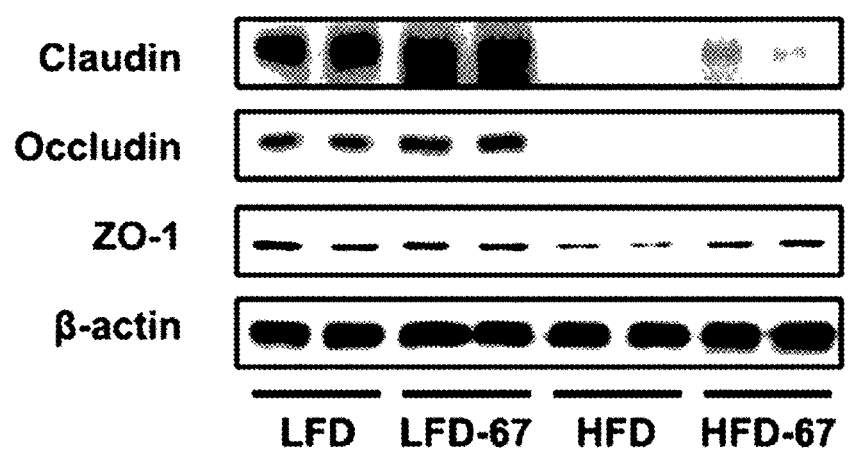
FIG. 17 illustrates the results of analysis of the effect of *Lactobacillus sakei* OK67 on tight junction protein expression in the colon of a model animal in which obesity was induced by a high-fat diet.

(5) Analysis of expression level of tight junction protein in colon Expression levels of tight junction proteins in colon tissues of sacrificed experimental animals were analyzed by immunoblotting. Specifically, the colon tissues of sacrificed experimental animals were homogenized in lysis buffer and then subjected to SDS 10% (w/v) polyacrylamide gel electrophoresis to isolate whole protein samples. Thereafter, the entire protein sample was transferred to a polyvinylidene difluoride membrane. Thereafter, the entire protein sample transferred to the membrane was reacted with ZO-1, occludin, claudin-1 and β-actin primary antibody (diluted at a ratio of 1:1000) overnight at 4° C. Thereafter, the entire protein sample was reacted with an anti-mouse immunoglobulin G secondary antibody (Santa Cruz Biotechnology, USA; diluted at a ratio of 1:2000) for 1 hour at room temperature. Thereafter, the sample was washed with PBS containing 0.1% Tween 20 three times for 10 minutes each, and developed after fluorescence color development. FIG. 17 illustrates the results of analysis of the effect of *Lactobacillus sakei* OK67 on tight junction protein expression in the colon of a model animal in which obesity was induced by a high-fat diet. As illustrated in FIG. 17, the high-fat diet caused a decrease in expression of ZO-1, occludin, claudin-1 which are tight junction proteins. On the other hand, *Lactobacillus sakei* OK67 effectively inhibited the decrease of the expression of the tight junction protein caused by the high-fat diet.

The *Lactobacillus sakei* OK67 strain inhibits endotoxin production in the intestinal microorganism and induces tight junction protein expression in the colon to mitigate glucose intolerance and obesity induced by high-fat diets.

6. In-Vivo Experiments on the Anti-Inflammatory Effects of Lactic Acid Bacteria (1) Experimental Method In order to investigate the effect of *Lactobacillus sakei* OK67 strain on the arthritis-induced model animals, a total of 28 mice of 8-week-old male DBA/1J were divided into four groups (NOR, AC, AO, AI) of 7 mice each. Bovine type II collagen was used as an immunogen to induce arthritis in the remaining groups of AC group, AO group and AI group except the normal NOR group. Specifically, 100 μg of a collagen immunogen was injected intradermally into the proximal portion of the mouse tail, and primary immunization was performed. On the 21st day after the primary immunization, the same amount of collagen immunogen was injected intradermally and secondarily immunized in the same manner. At this time, bovine type II collagen was dissolved in 0.05 M acetic acid as a collagen immunogen and the same amount of Freund's Complete Adjuvant was added to emulsify the bovine type II collagen.

From the next day after the secondary immunization, NOR group and AC group were orally administered vehicle (50 mM sodium bicarbonate buffer containing 1% glucose) daily for 20 days. In AO group, *Lactobacillus sakei* OK67 strain 1×10$^9$ CFU was suspended in 0.1 ml of a vehicle (50 mM sodium bicarbonate buffer containing 1% glucose) and orally administered daily for 20 days. In AI group, ibuprofen was suspended in a vehicle (50 mM sodium bicarbonate buffer containing 1% glucose) and orally administered daily in a volume of 50 mg/kg weight, and the experiment was terminated the next day.

(2) Analysis Method

Arthritis severity and arthritis incidence of paws were measured from the stage of arthritis induction.

The paws and vicinity of paws were observed with the naked eyes to assess arthritis severity of paws step by step by a macroscopic score according to the criteria in Table 3 below (Arii et al., 2008). The highest macroscopic score that may be given to each mouse is 16.

TABLE 3

| Step | Observation of appearance |
|---|---|
| 0 | normal |
| 1 | focal slight swelling and/or redness in one digit |
| 2 | moderate swelling and erythema |

TABLE 3-continued

| Step | Observation of appearance |
|---|---|
| 3 | marked swelling and erythema of the limb |
| 4 | maximal swelling, erythema, deformity, and/or ankylosis |

The volume increase of paws, myeloperoxidase (MPO) activity of the paw joint tissues, and tissue microscopic analysis were performed after the end of the experiment.

At the end of the experiment, the experimental animals were sacrificed and paw joint tissue was collected and immediately frozen at −70° C. and used as a sample. The myeloperoxidase (WO) activity in the paw joint tissue was measured using the Mouse MPO assay ELISA kit (Hbt HK210, USA). In addition, for tissue microscopic analysis, paw joint tissue was fixed with 4% paraformaldehyde, dried, embedded with paraffin, cut to a thickness of 20 μm. After staining with either hematoxylin-eosin, toluidine blue or safranin 0, the appearance of the tissue was microscopically evaluated.

In addition, paw joint tissue was homogenized in radio-immunoprecipitation assay (RIPA) lysis buffer, and SDS 10% (w/v) polyacrylamide gel electrophoresis was performed to isolate the entire protein sample. The entire protein sample was then transferred to a polyvinylidene difluoride membrane. Thereafter, the entire protein sample transferred to the membrane was reacted with COX-2, iNOS, p65, p-p65, p38, p-p38, JNK, p-JNK, ERK, p-ERK, TAK1, p-TAK1 and β-actin primary antibody (diluted at a ratio of 1:1000) overnight at 4° C. Thereafter, the entire protein sample was reacted with an anti-mouse immunoglobulin G secondary antibody (Santa Cruz Biotechnology, USA; diluted at a ratio of 1:2000) for 1 hour at room temperature. Thereafter, the sample was washed with PBS containing 0.1% Tween 20 three times for 10 minutes each, and developed after fluorescence color development.

In addition, the experimental animals were sacrificed at the end of the experiment and the spleen was aseptically collected. Thereafter, the spleen was ground to prepare single cell suspension, and cells were dissolved in Tris-buffered ammonium chloride, and then suspended in RPMI 1640 medium. Thereafter, T cells were isolated by using Pan T cell isolation kit II (Miltenyi Biotec, Bergisch Gladbach, Germany). The isolated T cells were stained with an anti-FoxP3 or anti-IL-17A antibody and the distribution of Th17 cells and Treg cells was analyzed by using a fluorescence-activated cell sorting (FACS) device (C6 Flow Cytometer® System, San Jose, Calif., USA). In addition, splenic T cell differentiation markers were analyzed using qRT-PCR.

In addition, expression levels of inflammatory cytokines, anti-inflammatory cytokines, prostaglandin E2 ($PGE_2$), and NO in the paw joint tissue were analyzed using an ELISA kit. Specifically, paw joint tissue was homogenized in a radio immunoprecipitation assay (RIPA) lysis buffer containing 0.1% protease inhibitor cocktail and 1% phosphatase inhibitor cocktail. Thereafter, the tissue homogenate was centrifuged to obtain a supernatant. The resulting supernatant was transferred to a 96-well plate and the concentrations of TNF-α, IL-1β, IL-10, IL-17 and PGE2 were measured using an ELISA kit.

(3) Experiment Result

Figure 18:
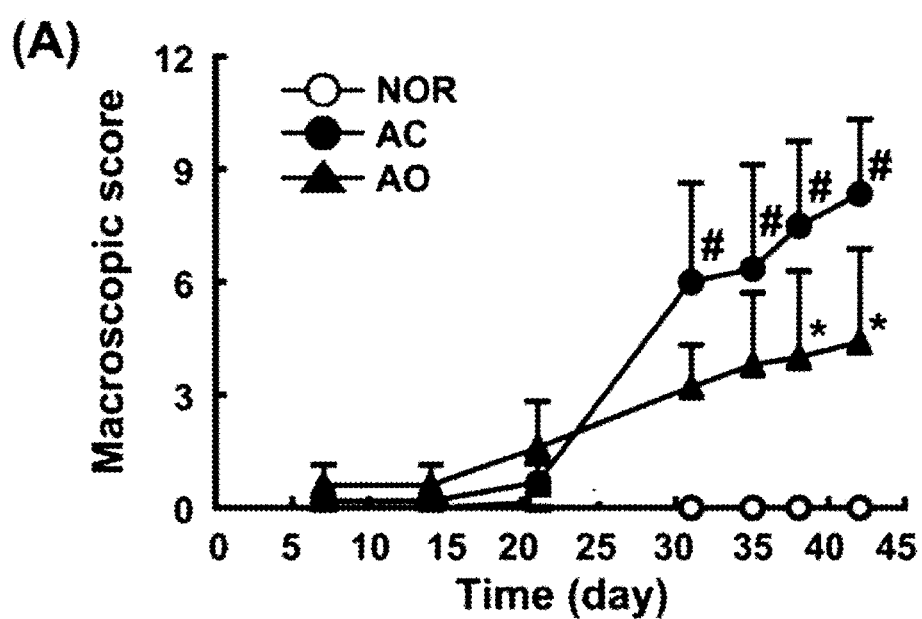
FIG. 18 is a graph illustrating the effect of *Lactobacillus sakei* OK67 strain on arthritis severity in a model animal experiment in which arthritis was induced by collagen.
Figure 19:
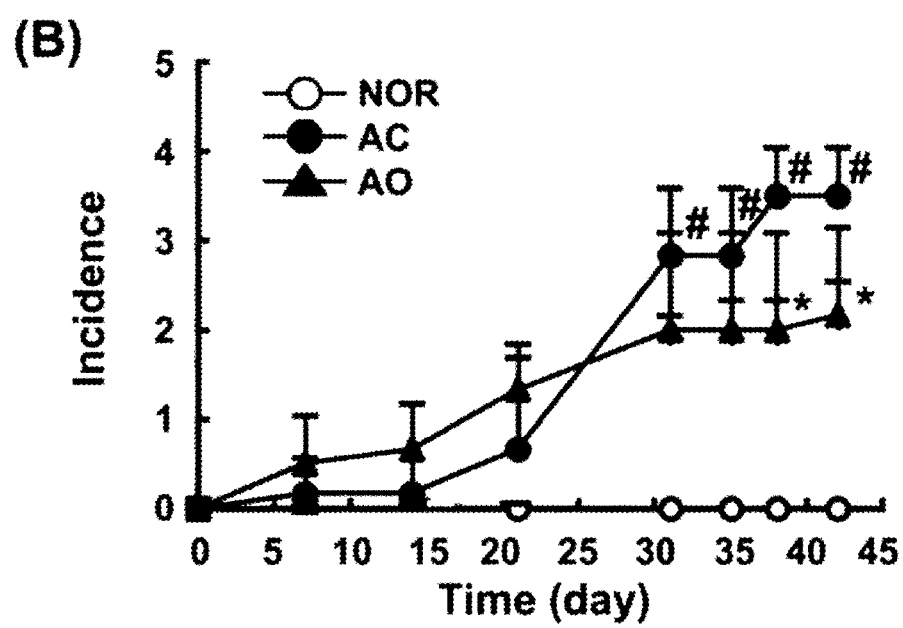
FIG. 19 is a graph illustrating the effect of *Lactobacillus sakei* OK67 strain on arthritis incidence in a model animal experiment in which arthritis was induced by collagen.
Figure 20:
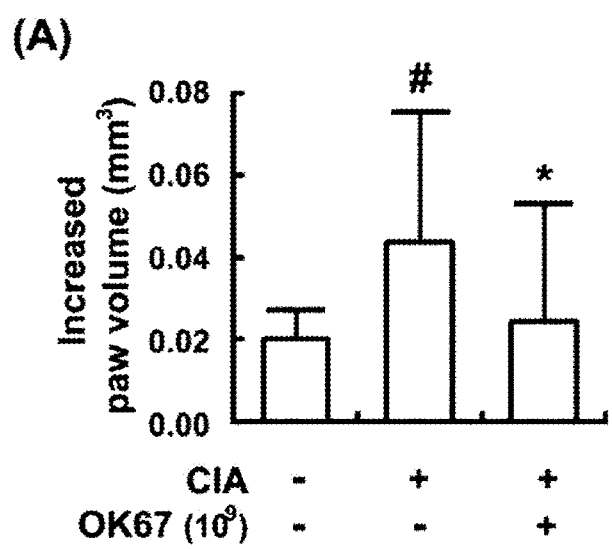
FIG. 20 is a graph illustrating the effect of *Lactobacillus sakei* OK67 strain on the volume increase of the paw in a model animal experiment in which arthritis was induced by collagen.
Figure 21:
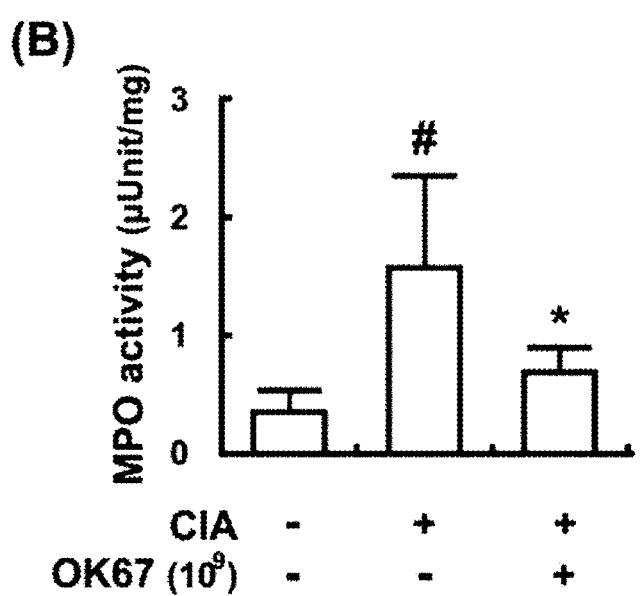
FIG. 21 is a graph illustrating the effect of *Lactobacillus sakei* OK67 strain on the activity of myeloperoxidase (MPO) in paw joint tissues in a model animal experiment in which arthritis was induced by collagen.
Figure 22:
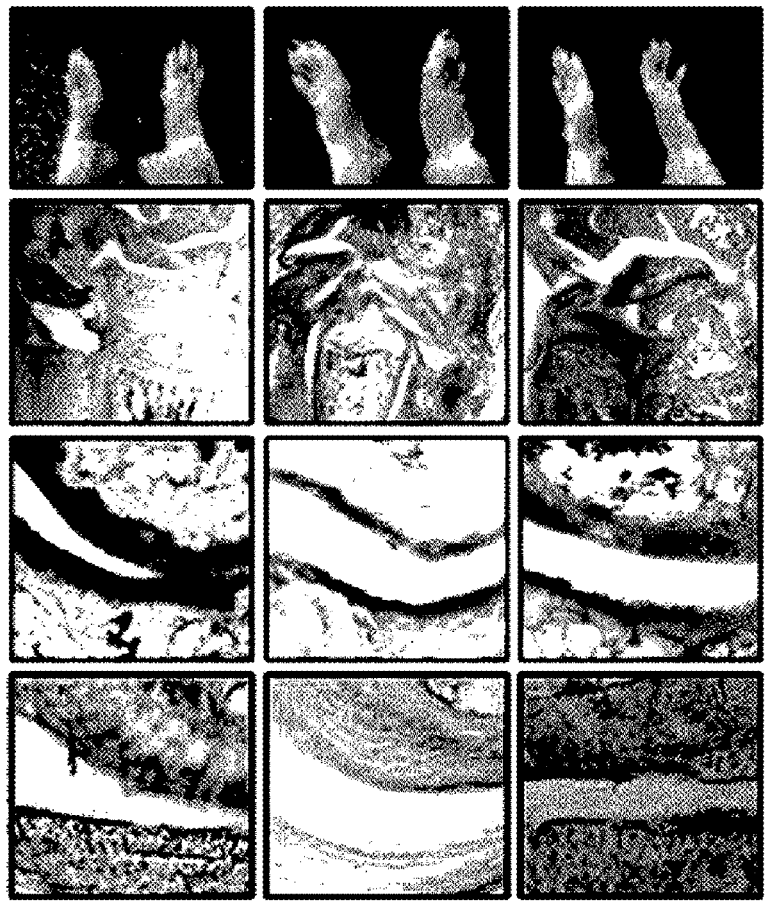
FIG. 22 is a photograph illustrating the effect of *Lactobacillus sakei* OK67 strain on micro-appearance of paw joint tissues in a model animal experiment in which arthritis was induced by collagen.

FIG. 18 is a graph illustrating the effect of *Lactobacillus sakei* OK67 strain on arthritis severity in a model animal experiment in which arthritis was induced by collagen. In addition, FIG. 19 is a graph illustrating the effect of *Lactobacillus sakei* OK67 strain on arthritis incidence in a model animal experiment in which arthritis was induced by collagen. In addition, FIG. 20 is a graph illustrating the effect of *Lactobacillus sakei* OK67 strain on the volume increase of the paw in a model animal experiment in which arthritis was induced by collagen. In addition, FIG. 21 is a graph illustrating the effect of *Lactobacillus sakei* OK67 strain on the activity of Myeloperoxidase (MPO) in paw joint tissues in a model animal experiment in which arthritis was induced by collagen. In addition, FIG. 22 is a photograph illustrating the effect of *Lactobacillus sakei* OK67 strain on micro-appearance of paw joint tissues in a model animal experiment in which arthritis was induced by collagen.

As illustrated in FIGS. 18 to 22, *Lactobacillus sakei* OK67 strain exhibited high anti-inflammatory efficacy and exhibited very superior improvement or therapeutic effect on arthritis.

Figure 23:
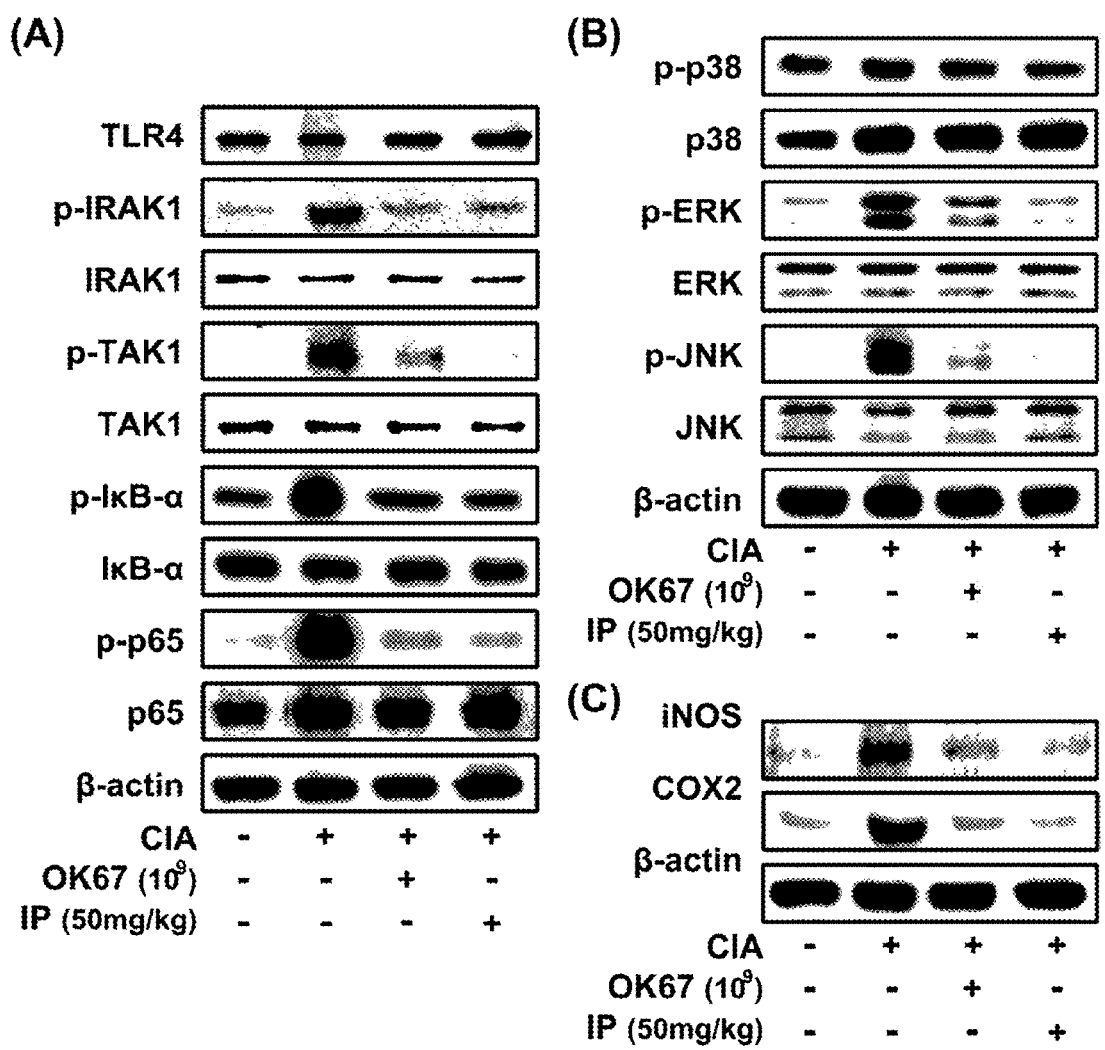
FIG. 23 is a photograph illustrating the effect of *Lactobacillus sakei* OK67 strain on the expression of iNOS and COX-2 in the paw joint tissue and the expression of signal transduction pathway elements such as NF-κB and MAPKs in a model animal experiment in which arthritis was induced by collagen.

FIG. 23 is a photograph illustrating the effect of *Lactobacillus sakei* OK67 strain on the expression of iNOS and COX-2 in the paw joint tissue and the expression of signal transduction pathway elements such as NF-κB and MAPKs in a model animal experiment in which arthritis was induced by collagen. As illustrated in FIG. 23, the treatment of collagen significantly increased the expression of iNOS and COX-2, the phosphorylation of IRAK1, TAK1 and IκB-α, and the activation of NF-κB and MAPKs (ERK, JNK, and p38). On the other hand, *Lactobacillus sakei* OK67 strain inhibited both the expression of iNOS and COX-2 and the phosphorylation of IRAK1, TAK1 and IκB-α, and the activation of NF-κB and MAPKs (ERK, JNK, and p38).

Figure 24:
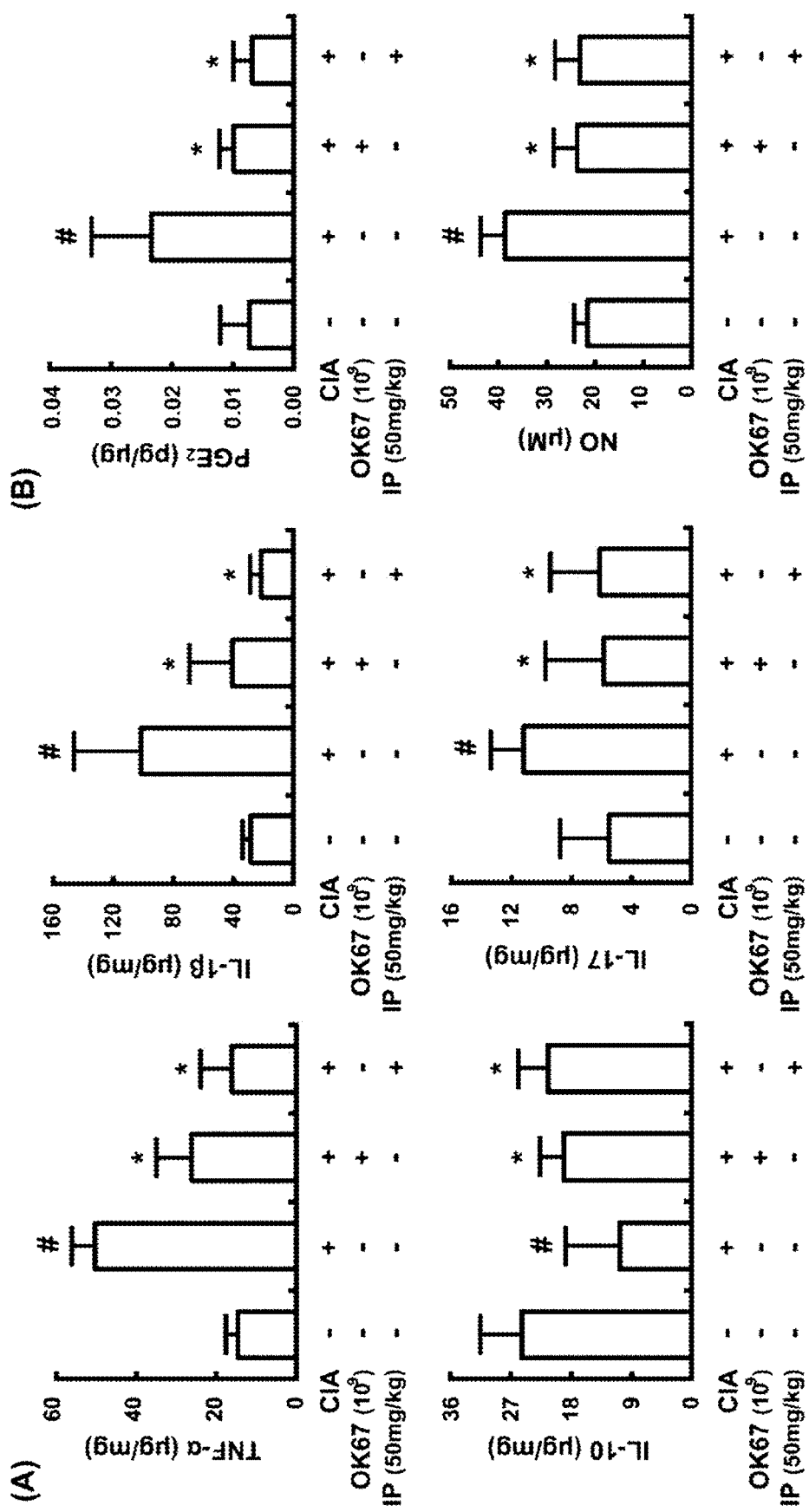
FIG. 24 is a graph illustrating the effect of *Lactobacillus sakei* OK67 strain of the expression of inflammatory cytokines and anti-inflammatory cytokines in paw joint tissues and the production of prostaglandin E2 (PGE$_2$) and NO in a model animal experiment in which arthritis was induced by collagen.

FIG. 24 is a graph illustrating the effect of *Lactobacillus sakei* OK67 strain on the expression of inflammatory cytokines and anti-inflammatory cytokines in paw joint tissues and the production of prostaglandin E2 ($PGE_2$) and NO in a model animal experiment in which arthritis was induced by collagen. As illustrated in FIG. 24, the treatment of collagen significantly increased the production of NO and PGE2, while *Lactobacillus sakei* OK67 strain inhibited NO and PGE2 production to levels of 89% and 86%, respectively. In addition, the treatment of collagen increased the expression of inflammatory cytokines (TNF-α, IL-1β and IL-17a) and inhibited the expression of anti-inflammatory cytokines (IL-10), while *Lactobacillus sakei* OK67 strain inhibited the expression of inflammatory cytokines (TNF-α, IL-1β and IL-17a) and induced the expression of anti-inflammatory cytokines (IL-10).

Figure 25:
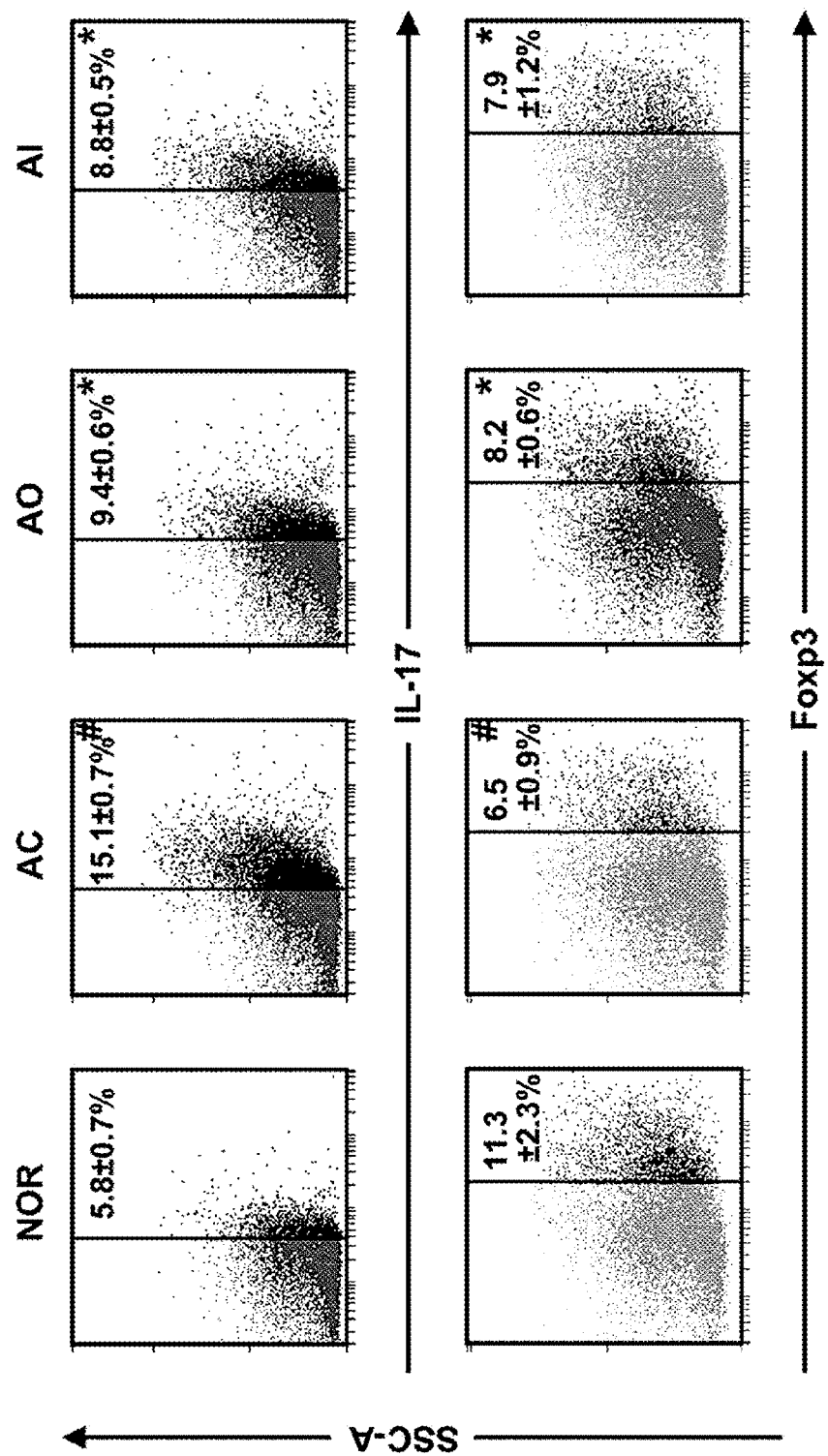
FIG. 25 illustrates the effect of *Lactobacillus sakei* OK67 strain on splenic T cell differentiation in a model animal experiment in which arthritis was induced by collagen.
Figure 26:
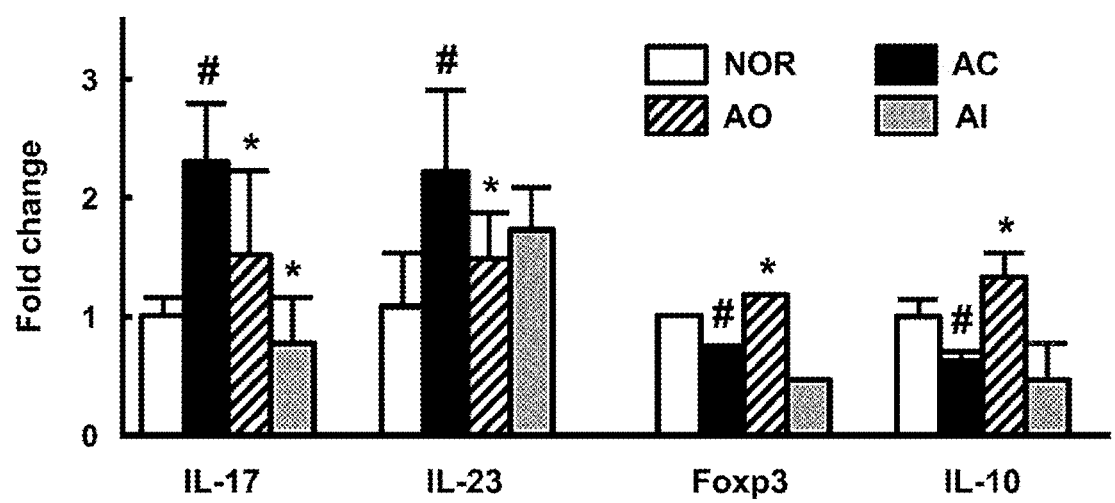
FIG. 26 illustrates the effect of *Lactobacillus sakei* OK67 strain on splenic T-cell differentiation markers in a model animal experiment in which arthritis was induced by collagen.

FIG. 25 illustrates the effect of *Lactobacillus sakei* OK67 strain on splenic T cell differentiation in a model animal experiment in which arthritis was induced by collagen. In addition, FIG. 26 illustrates the effect of *Lactobacillus sakei* OK67 strain on splenic T-cell differentiation markers in a model animal experiment in which arthritis was induced by collagen. As illustrated in FIG. 25, the treatment of collagen significantly increased the differentiation of T cells into Th17 cells (T helper 17 cells) and inhibited the differentiation into Treg cells. On the other hand, *Lactobacillus sakei* OK67 strain inhibited the differentiation of T cells into Th17 cells (T helper 17 cells) and promoted the differentiation into Treg cells. In addition, as illustrated in FIG. 26, the treatment of collagen significantly induced IL-17 and IL-23 expression and inhibited Foxp3 expression. On the other hand, *Lactobacillus sakei* OK67 strain inhibited the expression of IL-17 and increased Foxp3 expression.

*Lactobacillus sakei* OK67 strain inhibited the differentiation of collagen-induced T cells into Th17 cells (T helper 17 cells) and increased the differentiation of collagen-inhibited T cells into Treg cells. In addition, *Lactobacillus sakei* OK67 strain inhibited the expression of collagen-induced TNF-α, IL-1β, IL-6 and IL-17 and the activation of NF-κB and MAPKs (p38, JNK, ERK). On the other hand, *Lactobacillus sakei* OK67 strain induced IL-10 expression. Based on these results, the *Lactobacillus sakei* OK67 strain inhibits the activation of NF-κB and restores the balance of Th17/Treg cells, thereby alleviating inflammatory diseases such as colitis and arthritis or immune diseases. In addition, the *Lactobacillus sakei* OK67 strain restores the balance of Th17/Treg cells and regulates immunity, thereby alleviating immunological diseases such as rheumatoid arthritis and allergies, and may also enhance weakened immunity.

7. Effectiveness Evaluation of Alcohol-Induced Gastric Ulcer Improvement in Lactic Acid Bacteria (In Vivo)

(1) Experimental Animals

Five-week-old ICR male mice were purchased from Raon Biotech Co. and raised for one week under controlled environmental conditions in which humidity was 50±10%, temperature was 25±2° C., and lighting was repeatedly turned on for 12 hours and turned off for 12 hours, and then were used for experiments. The mice were fed with standard laboratory feed (Samyang, Korea) as feeds, and were allowed to drink water freely. In all experiments, six mice were used in one group.

(2) Induction of Gastric Ulcer by Alcohol and Sample Administration

In one experimental group, *Lactobacillus sakei* OK67 was suspended in physiological saline and was orally administered for three days in an amount of $1 \times 10^9$ CFU once a day, and in a positive control group, ranitidine, a commercial gastric ulcer treatment, was orally administered for three days in an amount of 50 mg/kg once a day. In addition, in the normal group and the negative control group, physiological saline was orally administered for three days in an amount of 0.1 ml once a day. Samples or physiological saline were orally administered for 3 days, and then the experimental mice were not allowed to eat food and drink water for 18 hours. On the 4th day of the experiment, 1 hour after the administration of the sample or the physiological saline, 0.2 ml of 99% pure ethanol was orally administered to all experimental mice except the normal group to induce gastric ulcer. In addition, in the normal group, 0.2 ml of physiological saline was orally administered instead of ethanol.

(3) Measurement of Macroscopic Indicators Related to Gastric Damage

After 3 hours of ethanol administration, the experimental mice were sacrificed and the stomach tissue was removed. The stomach was cut in a longitudinal direction and washed with a phosphate buffered saline (PBS) solution. The degree of gastric damage was visually or microscopically examined and scored according to the degree of damage (reference document: Park, S. W., Oh, T. Y., Kim, Y. S., Sim, H., et al., *Artemisia asiatica* extracts protect against ethanol-induced injury in gastric mucosa of rats. J. Gastroenterol. Hepatol. 2008, 23, 976?984).

(4) Measurement of Activity of Myeloperoxidase (MPO)

200 μl of 10 mM potassium phosphate buffer (pH 7.0) containing 0.5% hexadecyl trimethyl ammonium bromide was homogenized in 100 mg of stomach tissue. Then, the supernatant was obtained by centrifugation for 10 minutes under the condition of 4° C. and 10,000×g. 50 μl of the supernatant was added to 0.95 ml of reaction solution (containing 1.6 mM tetramethyl benzidine and 0.1 mM $H_2O_2$) and the absorbance was microscopically measured at 650 nm with the reaction at 37° C. Myeloperoxidase (WO) activity was calculated using peroxide 1 μmol/ml as 1 unit produced as a reactant.

(5) Measurement of Inflammation Index

The stomach tissue was purified with Qiagen RNeasy Mini Kit, 2 μg of mRNA was isolated, and cDNA was prepared using Takara Prime Script Rtase. Thereafter, the expression levels of CXCL4 [chemokine (C—X—C motif) ligand 4], TNF-α (tumor necrosis factor-alpha) and IFN-γ were measuring using quantitative real time polymerase chain reaction (Qiagn thermal cycler, Takara SYBER premix agent, Thermal cycling conditions: activation of DNA polymerase for 5 min at 95° C., followed by 40 cycles of amplification for 10 s at 95° C. and for 45 s at 60° C.). Table 4 below shows the primer sequences used for the quantitative real time polymerase chain reaction as per the cytokines to be analyzed.

TABLE 4

| Cytokines to be analyzed | Type of primer | Primer nucleotide sequence |
|---|---|---|
| TNF-α | Forward | 5'-CTGTAGCCCACGTCGTAGC-3' |
| | Reverse | 5'-TTGAGATCCATGCCGTTG-3' |
| CXCL4 | Forward | 5'-AGTCCTGAGCTGCTGCTTCT-3' |
| | Reverse | 5'-GATCTCCATCGCTTTCTTCG-3' |
| IFN-γ | Forward | 5'-TCAAGTGGCATAGATGTGGAAGAA-3' |
| | Reverse | 5'-TGGCTCTGCAGGATTTTCATG-3' |

(6) Experimental Results

Figure 27:
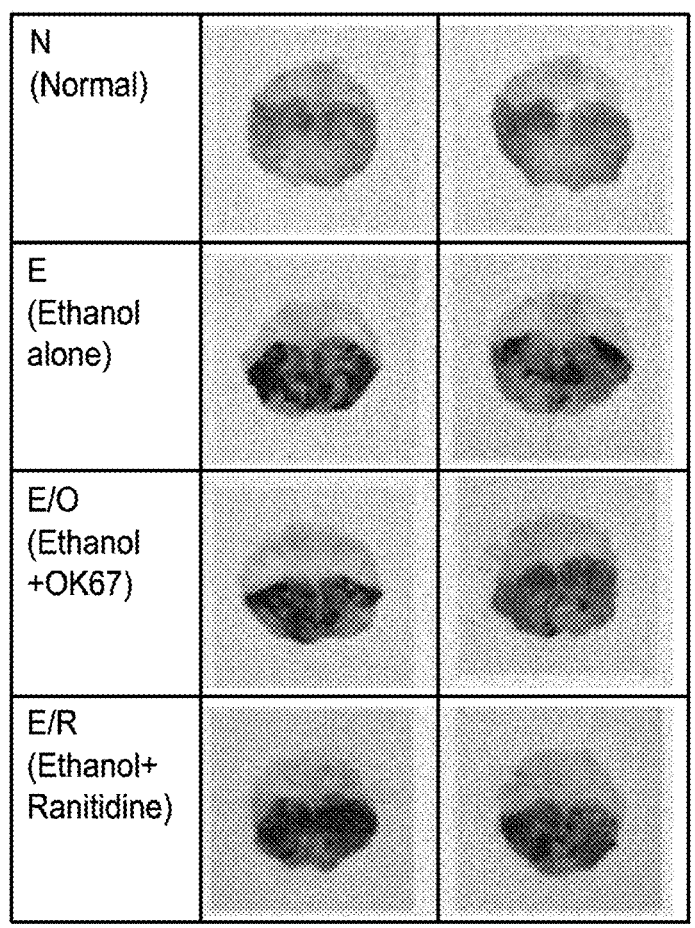
FIG. 27 is a photograph illustrating the effect of *Lactobacillus sakei* OK67 strain on the stomach mucosa of a mouse induced by gastric ulcer caused by ethanol.
Figure 28:
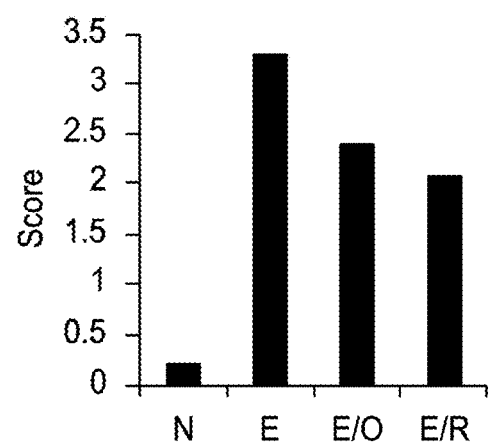
FIG. 28 is a graph illustrating the effect of *Lactobacillus sakei* OK67 strain on the stomach mucosa of a mouse induced by gastric ulcer caused by ethanol by the gross gastric lesion score.
Figure 29:
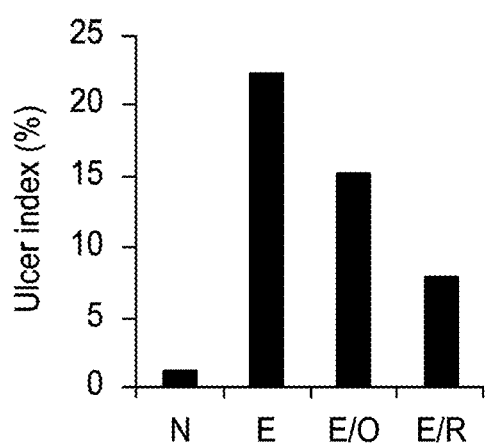
FIG. 29 is a graph illustrating the effect of *Lactobacillus sakei* OK67 strain on the stomach mucosa of a mouse induced by gastric ulcer caused by ethanol by the ulcer index.
Figure 30:
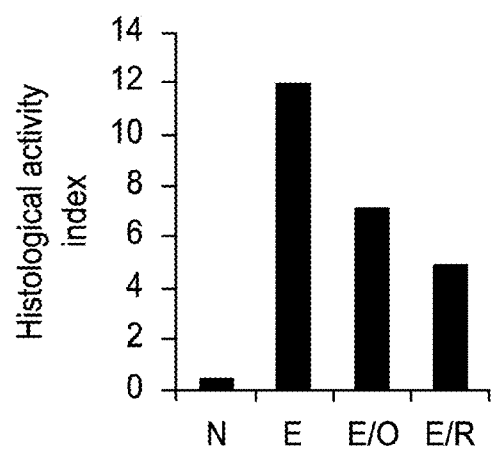
FIG. 30 is a graph illustrating the effect of *Lactobacillus sakei* OK67 strain on the stomach mucosa of a mouse induced by gastric ulcer caused by ethanol by Histological activity index.
Figure 31:
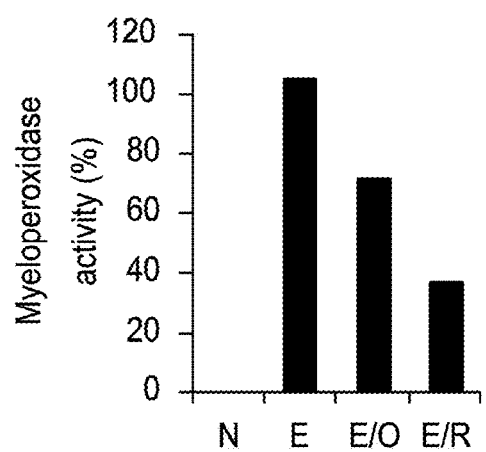
FIG. 31 is a graph illustrating the effect of *Lactobacillus sakei* OK67 strain on the stomach mucosa of a mouse induced by gastric ulcer caused by ethanol by myeloperoxidase (MPO) activity.
Figure 32:
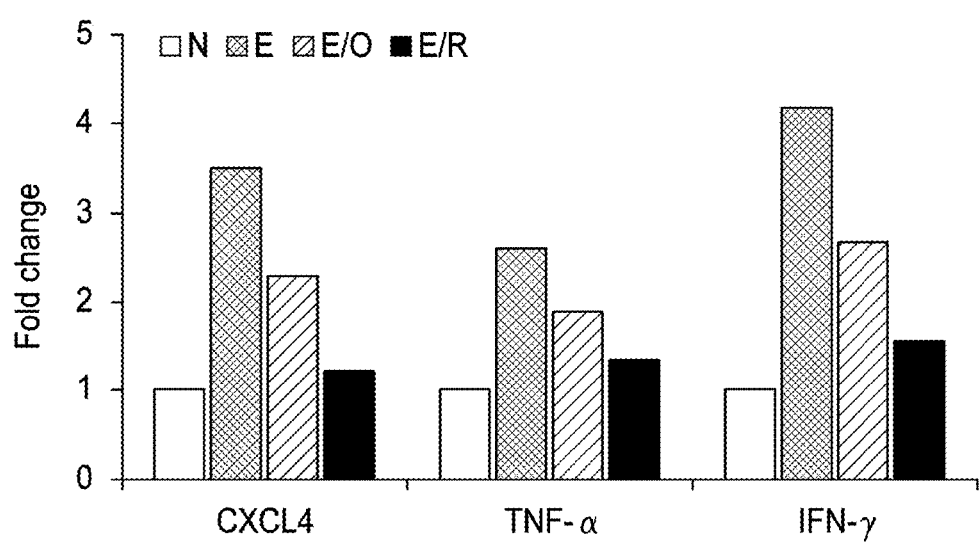
FIG. 32 is a graph illustrating the effect of *Lactobacillus sakei* OK67 strain on the stomach mucosa of a mouse induced by gastric ulcer caused by ethanol by the expression levels of CXCL4, TNF-α and IFN-γ.

FIG. 27 is a photograph illustrating the effect of *Lactobacillus sakei* OK67 strain on the stomach mucosa of a mouse induced by gastric ulcer caused by ethanol, FIG. 28 is a graph illustrating the effect of *Lactobacillus sakei* OK67 strain on the stomach mucosa of a mouse induced by gastric ulcer caused by ethanol by the gross gastric lesion score, FIG. 29 is a graph illustrating the effect of *Lactobacillus sakei* OK67 strain on the stomach mucosa of a mouse induced by gastric ulcer caused by ethanol by the ulcer index, and FIG. 30 is a graph illustrating the effect of *Lactobacillus sakei* OK67 strain on the stomach mucosa of a mouse induced by gastric ulcer caused by ethanol by Histological activity index. In addition, FIG. 31 is a graph illustrating the effect of *Lactobacillus sakei* OK67 strain on the stomach mucosa of a mouse induced by gastric ulcer caused by ethanol by myeloperoxidase (MPO) activity. In addition, FIG. 32 is a graph illustrating the effect of *Lactobacillus sakei* OK67 strain on the stomach mucosa of a mouse induced by gastric ulcer caused by ethanol by the expression levels of CXCL4, TNF-α and IFN-γ. In FIG. 32, CXCL4 expression level, TNF-α expression level, and IFN-γ expression level in the experimental groups except the normal group were expressed as a fold change based on the expression level of the normal group. In FIG. 27 to FIG. 32, "N" refers to a normal group, "E" refers to a negative control group in which gastric ulcer is induced by ethanol and physiological saline was administered as a sample, "E/O" refers to an experimental group in which gastric ulcer was induced by ethanol and *Lactobacillus sakei* OK67 was administered as a sample, and "E/R" refers to an experimental group in which gastric ulcer was induced by ethanol and ranitidine was administered as a sample. As illustrated in FIGS. 27 to 31, *Lactobacillus sakei* OK67 effectively alleviated stomach damage or gastric ulcer induced by ethanol. In addition, as illustrated in FIG. 32, *Lactobacillus sakei* OK67 significantly reduced inflammatory index levels in mice in which stomach injury or gastric ulcer was induced by ethanol.

8. Effectiveness Evaluation of Alcohol-Induced Liver Damage Alleviation in Lactic Acid Bacteria (In Vivo)

(1) Experimental Animals

Five-week-old ICR male mice were purchased from Raon Biotech Co. and raised for one week under controlled environmental conditions in which humidity was 50±10%, temperature was 25±2° C., and lighting was repeatedly turned on for 12 hours and turned off for 12 hours, and then were used for experiments. The mice were fed with standard laboratory feed (Samyang, Korea) as feeds, and were allowed to drink water freely. In all experiments, six mice were used in one group.

(2) Induction of Liver Damage by Alcohol and Sample Administration

In one experimental group, *Lactobacillus sakei* OK67 was suspended in physiological saline and was orally administered for three days in an amount of $1 \times 10^9$ CFU once a day, and in a positive control group, silymarin, a commercial liver damage treatment, was orally administered for three days in an amount of 50 mg/kg once a day. In addition, in the normal group and the negative control group, physiological saline was orally administered for three days in an amount of 0.1 ml once a day. Samples or physiological saline were orally administered for 3 days. After 3 hours, ethanol in an amount of 6 ml/kg was intraperitoneally administered to mice in all experimental groups except the normal group to induce liver damage. In addition, physiological saline was intraperitoneally administered to the normal group in an amount of 6 ml/kg in place of ethanol. Thereafter, experimental mice were not allowed to eat food and drink water for 12 hours, and then were sacrificed to perform cardiac blood collection.

(3) Liver Function Indicator Measurement and Result

The collected blood was left at room temperature for 60 minutes and centrifuged at 3,000 rpm for 15 minutes to isolate the serum. Glutamic pyruvate transaminase (GPT) and glutamic oxalacetic transaminase (GOT) of the isolated serum were measured using a blood analysis kit (ALT & AST measurement kit; Asan Pharm. Co., Korea). The results are shown in Table 5 below. As shown in Table 5 below, *Lactobacillus sakei* OK67 effectively improved ethanol-induced liver damage.

TABLE 5

| Experimental Groups | GOT (IU/L) | GPT (IU/L) |
|---|---|---|
| Normal group | 72.5 | 51.2 |
| Negative control group | 147.3 | 199.2 |
| Group administered ethanol and OK67 | 132.5 | 155.2 |
| Group administered ethanol and silymarin | 125.6 | 118.2 |

* OK67: *Lactobacillus sakei* OK67

9. Sequence Analysis of Full Genome of *Lactobacillus sakei* OK67 Strain

Figure 33:
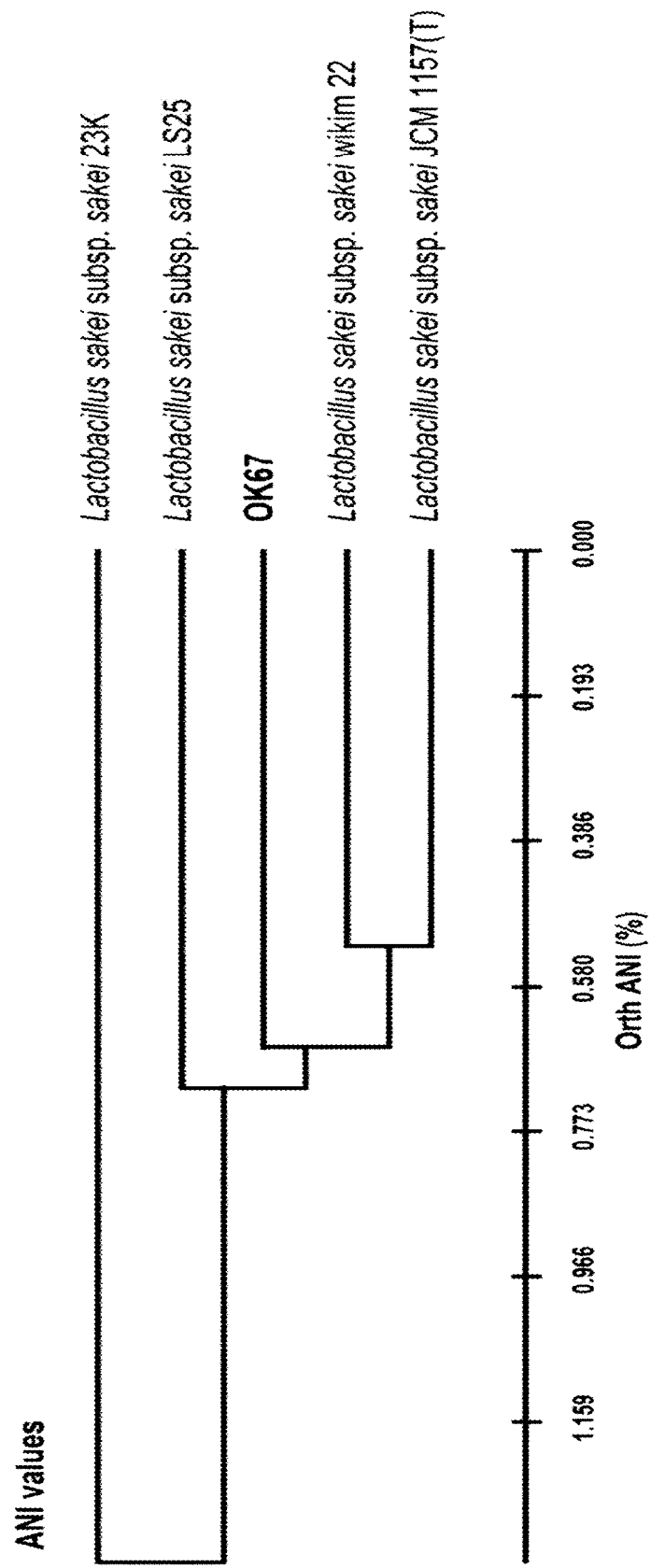
FIG. 33 illustrates a comparison of the average nucleotide identity (ANI) values between strains similar to *Lactobacillus sakei* OK67.
Figure 34:
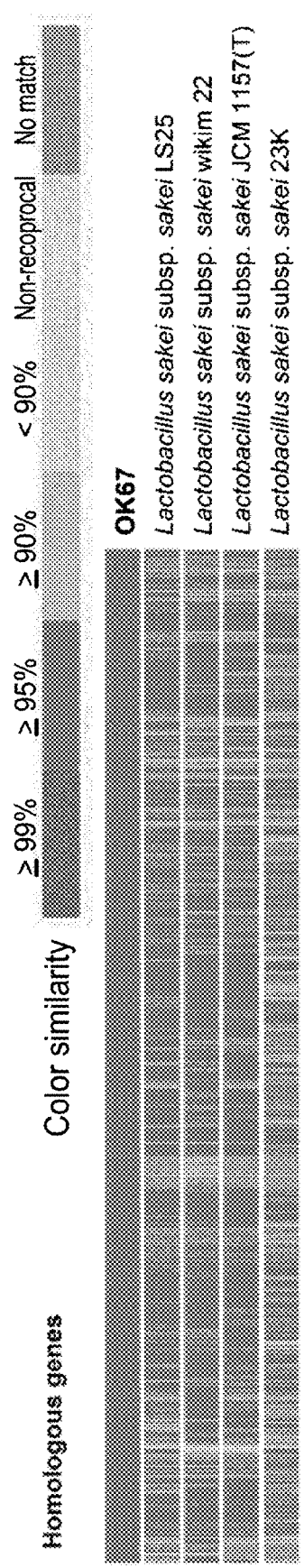
FIG. 34 illustrates the distribution of homologous genes between strains similar to *Lactobacillus sakei* OK67.

*Lactobacillus sakei* OK67 was inoculated into 500 ml of MRS broth medium and cultured for 24 hours. The cells were harvested from the culture solution, DNA was extracted, and the entire genome sequence was analyzed using Illumina HiSeq 2500 (Illumina CS Pro). The entire genome sequence of *Lactobacillus sakei* OK67 was identical to the nucleotide sequence as set forth in SEQ ID NO: 2 and its length was 1,781,778 bp. FIG. 33 illustrates a comparison of the average nucleotide identity (ANI) values between strains similar to *Lactobacillus sakei* OK67. In addition, FIG. 34 illustrates the distribution of homologous genes between strains similar to *Lactobacillus sakei* OK67. In FIGS. 33 and 34, the term "OK67" refers to *Lactobacillus sakei* OK67. As illustrated in FIGS. 33 and 34, *Lactobacillus sakei* ok67 taxonomically falls within the same species as *Lactobacillus sakei* subsp. *sakei* LS25, *Lactobacillus sakei* subsp. *sakei* wikim 22, *Lactobacillus sakei* subsp. *sakei* JCM 1157(T), *Lactobacillus sakei* subsp. *sakei* 23K, and the like, but is genetically different significantly.

10. Production of Pharmaceutical Compositions Including Lactic Acid Bacteria and the Like The *Lactobacillus sakei* OK67 culture in the preparation of the following pharmaceutical composition may be replaced by *Lactobacillus sakei* OK67 strain itself, its lysate or its extract.

<10-1> Preparation of Powders

*Lactobacillus sakei* OK67 culture 20 mg

Lactose 100 mg

Talc 10 mg

The above components were mixed and packed in airtight bags to prepare powders.

<10-2> Preparation of Tablets

*Lactobacillus sakei* OK67 culture 10 mg

Corn starch 100 mg

Lactose 100 mg

Magnesium stearate 2 mg

After mixing the above components, the tablets were prepared by tableting the same according to a conventional method for preparing tablets.

<10-3> Preparation of Capsules

*Lactobacillus sakei* OK67 culture 10 mg

Crystalline cellulose 3 mg

Lactose 15 mg

Magnesium stearate 0.2 mg

After mixing the above components, the capsules were prepared by filling the same in gelatin capsules according to the conventional method for preparing capsules.

<10-4> Preparation of Pills

*Lactobacillus sakei* OK67 culture 10 mg

Lactose 150 mg

Glycerin 100 mg

Xylitol 50 mg

After mixing the above components, they were prepared to be 4 g per one pill according to the conventional method.

<10-5> Production of granules

*Lactobacillus sakei* OK67 culture 15 mg

Soybean extract 50 mg

Glucose 200 mg

Starch 600 mg

After mixing the above components, 100 mg of 30% ethanol was added and the mixture was dried at 60° C. to form granules, which were then filled in a capsule.

<10-6> Preparation of injections

*Lactobacillus sakei* OK67 culture 10 mg

Sodium metabisulfite 3.0 mg

Methyl paraben 0.8 mg

Propyl paraben 0.1 mg

Suitable amount of sterile distilled water for injection

After mixing the above components, 2 ml of the mixture was filled in an ampoule and sterilized to prepare an injection.

11. Preparation of Food Composition Including Lactic Acid Bacteria and the Like

In the following preparation of a food composition, a *Lactobacillus sakei* OK67 culture may be replaced with *Lactobacillus sakei* OK67 strain itself, a lysate thereof or an extract thereof <11-1> Preparation of Flour Food To 100 parts by weight of wheat flour, 0.5 part by weight of *Lactobacillus sakei* OK67 culture was added to wheat flour, and the mixture was used to prepare bread, cake, cookies, crackers and noodles.

<11-2> Preparation of Dairy Products

With respect to 100 parts by weight of milk, 0.5 part by weight of *Lactobacillus sakei* OK67 culture was added to milk, and the milk was used to make various dairy products such as butter and ice cream.

<11-3> Preparation of Sunsik Product (Health Food)

Brown rice, barley, glutinous rice, and Job's tears were pregelatinized and dried by a known method and then roasted, and then were prepared into powder having a particle size of 60 mesh by a pulverizer.

Black beans, black sesame seeds, and *perilla* seeds were steamed and dried by a known method and then roasted, and then were prepared into powder having a particle size of 60 mesh by a pulverizer.

The above-prepared cereals, seeds and *Lactobacillus sakei* OK67 culture were prepared by blending the same at a following ratio.

Cereals (30 parts by weight of brown rice, 17 parts by weight of Job's tears, 20 parts by weight of barley), Seeds (7 parts by weight of *perilla* seeds, 8 parts by weight of black beans, 7 parts by weight of black sesame seeds),

*Lactobacillus sakei* OK67 culture (1 part by weight),

*Ganoderma Lucidum* (0.5 part by weight),

Foxglove (0.5 parts by weight)

<11-4> Preparation of healthy drinks 1 g of *Lactobacillus sakei* OK67 culture was homogenously blended with minor ingredients such as liquid fructose (0.5 g), oligosaccharide (4 g), sugar (2 g), table salt (0.5 g) and water (77 g), and was sterilized instantaneously and packaged in a small packing container such as a glass bottle or a PET bottle.

<11-5> Preparation of Vegetable Juice

Vegetable juice was prepared by adding 2 g of the fermented *Coconopsis lanceolata* extract of Preparation Example 2 to 1,000 ml of tomato or carrot juice.

<11-6> Preparation of Fruit Juice

Fruit juice was prepared by adding 1 g of *Lactobacillus sakei* OK67 culture to 1,000 ml of apple or grape juice.

12. Deposit Information of Lactic Acid Bacteria

On Feb. 23, 2015, the inventors of the present invention deposited a patent on *Lactobacillus sakei* OK67 on the basis of the Budapest Treaty to the Korean Culture Center of Microorganisms (address: Yurim Building, 45, Hongjenae 2ga-gil, Seodaemun-gu, Seoul, Republic of Korea), which is an authorized depository institution, and were given an accession number of KCCM 11670P.

From the foregoing, the present invention has been described by way of the above examples but is not limited thereto. It is apparent that various modifications may be made without departing from the scope and spirit of the present invention. Therefore, the protection scope of the present invention should be construed as including all embodiments falling within the scope of the appended claims.

SEQUENCE LISTING (2 sequences)

SEQ ID NO: 1 - DNA, 1376 bp, Artificial Sequence
  16S rDNA of Lactobacillus sakei OK67
tgcagtcgaacgcactctcgttagattgaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgccc

SEQ ID NO: 2 - DNA, 1781778 bp, Artificial Sequence
  Full genome sequence of Lactobacillus sakei OK67
atggaatttgctacattgttgtctgctgccggggttaaagtaaccgttattgtccgatccggccaaccgctagagggattttacagccaacacgttcatcagttagttgatgaaatgaaaaactcacttggtattaattttatatttaacacaaatgttacagctgttaccgaagcacaaactggctatgaggttcaatcagctaacggcaaccttggcacttttgataaagttattaatgccagtggtagagttcctgaaattaatgcattgaaacttgataatgctggtgtagagtacagcaaccgcggaattaaagttgataaatatttgaccacatcagcaaataacatttacgcaatgggcgatattgttgataaaaccgcaccagcattaacctctacggcacagtttgaagcagactacttaagtgccttacttactaataaaacaactgaacctcttaggtacccagtaattggaaccgttacgttcacattcccccaactcgctcaagctggaattagtattgataaagcaaaggaagacagtaattattcaattaaagatattgatattactcaaggtgactttttttatgctggaacagatgatcacgcacgattatcattagtctttgacaagcaaaatcatctcgtgggcgctgctgaaattagccaaacagcagtagatgatatcaatgcactaattcctgttatggcaattgatgttgatccagaggtttggaaagaaaagatgctaatggctttccctggtttagcatataaaattagaacattaatttaattatattatttctgcttcaataatttttatatctttttcataatctctttctgaataattctgttcaaatccccttaataactctgaatttagtttcttagctgacatttccattctaatcatagttatacttcccgaagtaaccccaccaacgactggaacaattttcgcaattccagaggctagtccctttttggttagtgttttgccagcaactatactagttattttttttaataatgggtaccacaaagttttcatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccaccgtaaagctgtacaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatctccgatgcgcttacgttgattaatcatcatgggacgctgttcaattgatcgccccaaagattgatgatatttggatcgttggtcaacgttacgccgttggcgtacgccatgttcaggtagatcattcaaggagaaaccaattctcccctgatttagccaattataaatagatttagtagctagtttaaattcgtgagcaatcatttagaagtcatagtcgccgctactcatagcttcagcattacccattagatagccagcaccaacttgtgaaaagaaatcatgattggccgtttcggttgaaattccgttcattacgattgggttgatatctttaatctcagcattggggaagcgagattcgaagcccatattttggagcgccttgttggcgttgtagtgaacgaattgtttaacgtcttctgctaaaccaatcggcgcgtagacttcttcggtgaacgcaaactcattctcaaggagatcatcgagcaactcatccatccactttttgaatgttttttgttcagtcgccgatagctcgttatatcccaattgaaatttgtagccgaggtaggtaccatgaacagattcatcgcggatcaccagtttgataacttcagaaagatttgccagcttattgttaccacggtaccaaagtggggtaaaaaagttggtgtagtacaaaattccttcaagaaagacgcttgcaactttcttttcaaggttgtttcccgtttgataaatatcattgatccgtttggctttgtattgcattctgggattattgttcatccatttgaatacttcgtcaacagtggcttgatcgttcaaagatgtcaaaatagtgccgtagcttttggcatgaattgactccatcatcaaaaagtcattgaggactgctgcttcttttcgtgtccgaacgtcgggccgcagcacgtcgactccttcttcggattggagtgtgtccagcaaggctaatccacccacaacccgattgataaccgatttttcggtgccagagagtgtccgccagtcccgtaaatcattagaaacaggtactcgcgtatccagccagtattgtgccgttgctttatcccatacatattcgtcaagttcgtcttcgatgacgtcccaattaattgttttatagctcatttaaaagtcgtagtcgttatcggtcattttttcagtgtccgattcattgtttgcagccgttacctgttgcaaaaattgattttggtcaatcatcagttctttgagttgcgccactagtgaagacggttgaacttcgtagacagcgttaaagccaagtgacattaatgcatgattggcaccataggaggccagattgatggcttcggtggcatcgtcaaggttagcttctaagaagtctttttcagtttgcatgagttgatcaaactgtgtattaatccaatactgcagttcggtttgatcacttacagtgagttcttcaaatctgaggcgaaatttgtaaccaatataagcactaaaaagagcgctaccgcggagaatattagccaacatttggtaagtattgacgagatcctgtgtttgaagtattgtccagtatttaccaaacgagagcccagtttcagtcagaataaaaagggcttttttctgtaaggccatatcgctagtgctcgtttgggctagttggtcaatttcagcttgcagattggcattatcatctgcccaagtaaaacttccaccatcgttacccggaatcagagcccgaaaaatggtcgtacagcttttggcatggactgatttcataaaggtaatggtgtttaatacggattcttcttgttgagttctccgatcgtggcgaatagcaggggtgccaacttctgattggtagacggctaacattgatgtacctgccaacatacgagtaatggcctgttgttgagtatctgatagctgttgccaatccgtttgatcattcgtgatgggaatccgaatgtccaaccaaaagttagtggtgagtcgttcccacatgtatttatcgaaattatctttaatatcatcccagttaattgctttgtagtataaatagtccatctagatcatgcatgattcacattcatttgccgttttaatttcatcgtcttctgtaaacgttcgaatgtaataaagtgacttaatgccttttgtccaggcgtaattccgtaaccggttaaggtctcgggttgtcatctttaaattgttattgtccttccactcgtaaaggtcaggtttcaaaactgaacgcataaatagtgtcagactcataccttgatcaatgtgcttttgagctacggcataggtgtcaataatttttcgttgatcaatatcatatgcgggtgtgtagtaaggcaaagtttcgttagacaggtaaggtgctggatagaagattgagcctaccttattttcctgacgttgttctactaattgtgtgattggatgaagtgatgcacttgtttcattgacgtacgaaattgacccgttcggtgccacagcgagtctattacgatgataaaggccgccagtaatcacagcttgcttgagtgccttccaatctgtaacagatggtaatttaatatttttgaagatttttgcaactttggtactcttaaattcaaagtctgcgttcaagtattgatcgaagtaactgccatcagcgtactttgattggtcaaatttagcgaaggtttcgtggcgttcacgggcaattcgattgctcgtaacgagtgaatagtagtttaaagctaggaagtaggcatcagtaaattcaagggcctctggtgagccatactcaatttggtggcgtgcaagggcagtatgcagacccatagcccctaatccaatcgtgtggtaaagttcgttaccatgtttaacagtcggtacttccttaacgtcggttgtgtcagttacgagggtgagcgcacgaacagcaacctcaactgagtgaccgaagtccggcgagtcaatcatattcatgatattagttgatccgagattacatgaaatatcggtgccaattgtcttgtacgataggtcatcatcaagttttgacggttcttgaggctgtaagatctcactacaaaggttactcataataattttgccatcgacagggttagtttgattggccgtatcaatgttcaagatgtaaggataaccagattcttgttggagttgagaaatcttttgttctagtttccgcgcgttaaagactgacttcttaatattggggttagcgaccatgttgttatattctttggtgatatcgatgtaagcaaatggcgtacgatattcacgttcgacatcataggggctaaaaagatacattggttcgttagtcttgagtaattcataatatttatcaggaacaatcaaaccgagggacaaggtcttcacccgaattttttcgtccgcattttcctttttggtatccagaaaatgtaagatgtcaggatggaagacgttgagataaaccactccggcgccgttccgttgcccaagttggttactgtagctaaatgagtcttcaagtaacttcatcactggtataacgccagacgaggcgttggaaatctgcttaataggatcacctgaggcgcgcaagtttgacaggttaacgccgacgcccccaccgattcgagatagttgaagggcagaattaacgccacgtccaattgagagcatggagtcggccacatcgattaaaaaacatgataccatttcaccgcgccgttttttacccgcgttgagaaacgtgggggtggcaggctgataacgttgtgaaatcaattcatcggcaacgtcattggcaagttgttcatcaccattagcgagatagagggcattgaagacgacgcgatcgacaaagtcttccaaaaattgctggccatcattagttttcatggcatattgtgtgtagaacttgtaggcaccgagaaagctgcgaaaacgaaagtgatggtctctcatttggtcgaacaaggactgcacaaacttgtgagagtattgttccaggatacttggatcgatataatcttcgtcaaccaagtaatttaacttggcatttaacgaatcaaattgctcggtcttcggtttaactgtctcttcgaaataagcctttagggcttcttgatcataatgtagcggaatttctccgttgcttgggatatttactaggttatttaagtaaaaataggtattttccatttctggggtgctagttaccatttactcctttgttgtttgaaaacagaattgatcgcgataggttaagatggcatcggcaatgcgaggaatgtcgtgtacggtgccacgtagctcaaaatcggtaatgtaaggaaaaccgaagcgtttagcatattgtttagccgtgagtgcaaactgcttattaaaattacgattaccgctaccgataataccgtagcaatgctggtaattgccttcgtacgcgaggtaatctcccaaaatagtagttaatatttcagtataaccgttattaaccccattaccacctttaataaaggctggtaggaaggtaacaaacggctggtcaagagtggtgaattcagggtgttctttaacattaatggaactaacctgaacatgacgttctttctcaaagtatgttgtcagtctgctaataaaatattttgtgttgccactcaattaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgcctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaagcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaatcaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaatcaatgcacatcgaatttctttcggtatctgataaaggttgtccgtttaatcccggtattacgggcaacatctacatcactcatgcccgtctggtaaagtttaaaagcatgtagtaaacggggatcatcttcggcatattgaggtttccgaccatgatatttaccctgctgtttagcgagggcaatcccttgttgctgccgttcaatgatccgcttacgttcgctttcagcttgatatttatacagttcaataatgagattcgtcatgagctggcgtaaattaggatccgcaatccctgtcatggacggcaagtttaacacatctagggtggcccccttattttgaatggtgttcatgatcttagttaagtcctggttgtttcggcctaagcgatctaattcagtgaccaggacaatatcaccctcgcgaacataggcgagcattttttgcagttctggccgattagtgttagctccacttaatttatccgtaaataatttatcaacgccttttaaggccgctagctgtcgatctaaatgttgctctttggaactcacacgagcataaccaattttagccatttaatcattacgacgtttcttgataccaagaaaaccgagtaaacttccaaatgccaacaaaataccaataaatgacattgtttgactttgactattgttttcaccagtttgaggtaattctggtgaattaacagcaccgttgttaactttagatcctgtattagtcgacgtattgattactccattgttagtagcgttacttggctgggaaggattccctggttggttagaactaactggagtcttggtataggtaaccgtgaattctaagtcctttgagtccccattaactgtttgcttgtcaatttgcgccttgtcagctgtataaccctttaattcaggacttgtgactgcggcaaagctttgatcagctgaccaagacccataggtctttttaccagtgaccttgtcggtcgttacagtacgcgtaaaggtcacttgagcggtgttatcagcaggagtttgattaccagcgccttgataatgaatagtttctgtaacggttttggcctctgtagactgaatgttttgatgcttcaagtgaaccgtgaaattctgatcagttgtgtcatcattgtcgaacgtcaaatctgctggatagccatcggtgaccaactcatacccttgtttcttataatcggcaatgctaccgctggtactatagctggattttgaacccgttgttcctgagattgagtccgtctttaaagtttttccagtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgttggtacaccggctggtgtaacctttgtcgcatcacttgggtcatttggatagactactggtcgtgctccagggaagtgcccatcacttgagcttggtaccaatgatccgactttcgtgtatgtcacggtatcattaacatctgctgaatcggcattcaggtcagttacggcagctgtctgcgctttatcagctacagatcctggcaccactgggctaacaacggcatcaaaggtcgtatcaccatttgtcgctgtccaggctgttgtcccagcaccacttgtaataacttcaccagtaacgttatcgacaacgactgttcgtgtgaagttgacagaatcagtgtgttgcttggccactacctgtccattctgatcaacatagctaatcgtctcgttgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcggtgaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactgttgctgctccagggaagttcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgctagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactgttgctgctccagggaagttcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgctagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactggtcgtgctccagggaagtgcccatcacttgagcttggtaccaatgatccgactttcgtgtatgtcacggtctcattaacatctgctgaatcggcattcaggtcagttacggcagctgtctgcgctttatcagctacagatcctggcaccactgggctaacaacggcatcaaaggtcgtatcaccatttgtcgctgtccaggctgttgtcccagcaccacttgtaataacttcaccagtaacgttatcgacaacgactgttcgtgtgaagttgacagaatcagtgtgttgcttggccactacctgtccattctgatcaacatagctaatcgtctcgttgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcggtgaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgttggtacaccggctggtgtaacctttgtcgcatcacttgggtcatttggatagactactggtcgtgctccagggaagtgcccatcacttgagcttggtaccaatgatccgactttcgtgtatgtcacggtatcattaacatctgctgaatcggcattcaggtcagttacggcagctgtctgcgctttatcagctacagatcctggcaccactgggctaacaacggcatcaaaggtcgtatcaccatttgtcgctgtccaggctgttgtcccagcaccacttgtaatcacttcaccagtaacgttatcgacaacgactgttcgtgtgaagttgacagaatcagtgtgttgcttggccactacctgtccattctgatcaacatagctaatcgtctcgttgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcggtgaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgttggtacaccggctggtgtaacctttgtcgcatcacttgcgtcatttggatagactactgttgctgctccagggaagtgcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgctagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactggtcgtgctccagggaagtgcccatcacttgagcttggtaccaatgatccgactttcgtgtatgtcacggtctcattaacatctgctgaatcggcattcaggtcagttacggcagctgtctgcgctttatcagctacagatcctggcaccactgggctaacaacggcatcaaaggtcgtatcaccatttgtcgctgtccaggctgttgtcccagcaccacttgtaataacttcaccagtaacgttatcgacaacgactgttcgtgtgaagttgacagaatcagtgtgttgcttggccactacctgtccattctgatcaacatagctaatcgtctcgttgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcggtgaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgttggtacaccggctggtgtaacctttgtcgcatcacttgggtcatttggatagactactggtcgtgctccagggaagtgcccatcacttgagcttggtaccaatgatccgactttcgtgtatgtcacggtatcattaacatctgctgaatcggcattcaggtcagttacggcagctgtctgcgctttatcagctacagatcctggcaccactgggctaacaacggcatcaaaggtcgtatcaccatttgtcgctgtccaggctgttgtcccagcaccacttgtaatcacttcaccagtaacgttatcgacaacgactgttcgtgtgaagttgacagaatcagtgtgttgcttggccactacctgtccattctgatcaacatagctaatcgtctcgttgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcggtgaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactgttgctgctccagggaagttcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactgttgctgctccagggaagttcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgatcgttgtatctttcgttggatcacttggctgataactgctacctggtgtcaaaacatgaccttctggatcatgtgctgtataacctggtaccgtcggtacaccggctggtgtaaccttcgtcgcatcacttgcgtcatttggatagactactgttgctgctccagggaagttcccatcacttgagcttggtaccaatgatccgactttcgtgtatgtcacggtctcattaacatctgctgaattggcattcaggtcagttacgacagctgtctgcgctttatcagctacagatcccggcaccactgggctaacaacggcatcaaaggttgtatcaccatttgtcgctgtccaggctgttgttccagcaccacttgtaatcacttcaccagtaacgttatcgacaacgaccgttcgtgtgaaattaacagaatcagtgtgctgcttggccactaagtgtccattctgatcaacatagctgacggtctcattgaccgtcttatcatagttggtgcgagttggccactttggtccatctggttcatctggattgattggcgctcccggtgtctgtggatccgttggattcactggcgtcagctgatgcttcaagtgaaccgtgaagttctgatcagttgtgtcatcattgtcgaatgtcaaatctgctggatagccatcagtaaccaactcatacccttgtttcttataatcggcaatgctgccactagtactataactcgatttcgagcccgttgttcctgaaattgaatccgtctttaaagtcttttcggtcgtatcatcaacgtagctgacactaccttcttgctgatctgctgtataggtgattattgtatctgtaccattatcagaaggtgttggtggaatatagcccttagtacgatcatcgggatcaactggcaccaaaggagtccccatatgatcttcaggtatatagccaggaataaaagcaataaccggataatcaggcaccgatgaatcagcaatcttagtagggttactaggatcattgggataaattcttgacgttgttgagccatcaggattatagacaatccagttgccgagcttgctgtaaacatacttaatatcagaggtttgtggaatatatggatttttaattccgtatgtcgtataacctagtggatgatacattatcgtagaatctgagggctttatacttgtccatgttttgagaacttctccatttttagcaattgaagcagacattgttccatctgaaccagtctgagtgtaagtaataactactccatcatgaaagtttttaacataactagcaccaatctctccgtatggtgacataacgccatttgaattagaaggtgcagtagcatagtaaccatttacaacatttacgtcgctggtcgtataattttggccaactaaccctttttgtgtataagcaacaaccggattaccattactgtcggtgatttgcttgccatctttatcaacgtaataggttgtttgtgtgatcaatttgggtacaaaataagaaagtgtattgtagtagttactatcaaatttactagcagtatatttagtaacaaaactattgtttgaacttcgaaccatttcaaaataagcatcattatagtaggtagtgttgtcaaatacagcagatgttacctgagaattttgatttaaagtgtattgttttaaaacttgatttaatgccgataattccgttacataaacaattccatcgcccgttcgattagttgaaaaaacaatctggtttccactagattttccactaaattttgcttgcaaccattcataactgtaatgagagttatctggatcaatccacattccagatggataatctggatcactaactgagaaacccgtattggtaactgaacctgccaaagtggctatctgcgctacactctgttttccacctgcactggttgaatcggcattcactgcactgctactacttgcaccggtcgtttcagcattcgttgcactgatactatttgcactggtcgtttcagcctttactgcactactgttatttgcactggttgaatcagcattcgttgcactgttactacttgcaccggtcgtttcagcattcgttgcactgttactacttgcaccggtcgtttcagcctttactgcactacttgctttatctgcatctgtacttttgctactagtggttgatgttgcactacttgctttatctgtatctgtactttcgctactagtagttgatgctacactacttgctttatctgcatctgtacttttgctactagtggttgatgctgcactacttgctttatctgcatctgtactttcgctactagtggttgatgctgcactacttgctttatctgcatctgtactttcgctactagtggttgatgctgcactacttgctttatctgcatctgtactttcgctactagtggttgatgctgcactacttgctttatctgcatctgtacttctgctactagtggttgatgctgcactacttgctacagtagctgctgaggtggtatcagcatgaactgctaccgttgataccccaccgaagacaagaaaagacagtgtagtaattgcggcaaaaacgaagttttttccatctttatacattttataatgtaatttcttttccaccattataaacttcttataatgtaatttcttttctcccatatgaatcagtcaacttttcagctacttggtaatgttgcttcagcagatttctacctttgtggaggcagtgatattactttaatatctgataataatgcctataatatgaaagctttagcccaagaagcgcttaaactgcgtgttcctaattctttgaccgttattgatttaaacaacttctacgttggtatgatccctattgatcataatcagatattgaccatgatttctcatattaacaccaccattatcccattcaattatcaggaaatcactaattttatcgggtctataatttttggtgttggaaagtatttccattctaaaagtactaggccctaaatgatcgctttacatgccatgcatttacgccaggttcaaaatgtcttagttgatggtggttattcaggcgttaattttcagctcgatgttgccagtaatttaaacgcaaccgtgcaggttgcgaagcgcaatgagttgcatcgattcgaagtcatgccccaacgttgggtagtcgaacgatcttttagttggctagagaattgtcggcgactttggaaaaattgtgagcgtcaattaaccaccagtctgcaaatggtcgttttagcgtttttagcactattacttaagagattttagtcacatcttccgccagaccttcagcataatcagcatcgccacaatcaaggcgacagaaatccccaaagtcagcatccaagcatattgcatcccggctaacgggagtttcacgttcatcccatagaatccggtaatgatcgttggcacagccatggtcagtgaccaaattgtcaaaaatttcattgtatcgttcaggttgttattagcaaggctgttgaaggtatgatcgattcggtcaacgacttgggtttcaatctcaaacatccgttggacctgttctccttcaatttgcacgtcttcgaataaatcaattttatcttggtcagcaccgacaccaaaatgggtctttggcaaacgatcgagttcactgagattggtttggaccgcgctggacaaaaaggtcaacgtctgttgaagatatgaaagtgaaaccaagtcactgttcttcgtcttccggttcaacattttatccaaatagttgcgtttcttggtaatggcgcgagaaattgggataaagctgtcaacaactgtaaacagtgtttccagaataaatgcatcgacgctcttaacctcgggattatccaatgccgagtaaagtgccgtgttgacttcaggtatgtggctttgattaaacgtgaataaaacgcccttatggagcaatatgccaaatggctgggtaatgtatctcagcgcatctttgtcgagggcatacggcgccagaaagatgaataattggtcgtcctcattgatatcataaacataattagtactttcatcattatcagtgacgtactcaataatatcttcatcgatgccatactgatcttcgagggttgcccgttcttcggcattgatttgaatcgtttcaatccatttggttccattgattgtcttttcgggtttgatcattcatttgatcaactttatatcggctttgtgatcatcaaataaagcttgccaaccttgcttagttgggaccttacccgttgctttaaaattggcgtcaccaacttgggtaataatggtagtttcctcgtactcgtacggatcagcaaacatcgctaacgtcgttcttaaaaccaagtcatagacttgttgctgtaatttaggtaaggtagctaattgatctttagtcgggacgattttagtcatgataatggcgtagtgttcttcaaccttctttccattaacatagcgcttattcggggcggtattggttaaagcgacttgcttagagactaaacccagatacttcgtcagattagccattaaatactcaaattcttcatcagtgatataagcacaatcggttcggggatagctaaggaacttggcttcgtataaactctgaatggccgccaaagtctggctggcactggcgtgataacgtttattcatggcactttggagactggatagtgagaatagttggtgactagcacgctttttagcctggttttgaatgcccttgattaaaccagcctgtgatcctttctgaacgtgtttagcttgcatttacaagtgcatgcccccatcttcatgccggtttcgagtttggtgttgccgttgctttttcgtcatttcccactcagtctcctttaaaccttgcgcctgtttttgccgttggtaatcttcatcacgggcatatagagcggccatgattgcgtcactaaaggccgtctttaggtaatattctggactaactggcttgtagttcaatggttgataatgtgccagctgggattttcggtattgatcgtccttagcttgttgctcttttaactgtttttggattttctcaatctgactgttcttaatcgttggatcgactttacattcacccaaaaagagttgtttagtgccgttatgctttaaaacccgttgtaagtgatgattctctaactgatctaagctaagctgtcccgacaagtaagatagtccttgttgatgttcttggggactgaacacctgtggtggatttgcttgccactgttcaattgtttcagcctgacatggctttaaaacaggatcatagtacatcacggctgtataggcttgttcctgtttaatcattggtaattcattaaaattgccgttaggaaaagctcttcttaaaacttcctggtattgggtttgaataacttgcttcacagccatgattgttcgcaaatctttgactgcgcgagtaatcttttgctgctcggttggtgaatacttttctagtagaccttgatcaacgtgttctagactttctaagctatcatcatgaatcatcagcgtatatttaagctcgattttgacttccttttcttgttgcattaatatcttccagccaacgtatggccgtttggtaaaggtcaataattgtcggaccaataaatcatcacgaatattcattaaacgttcgtttaattcactgcctttgaaaatcgtttgttcactattagtttctttaatcaattcccgtcgttcagccgcggttgtctgttcaaaatcaagctctggataaagttttttagtcgtgcgatcaactactttatttaagagttcatctgctttttttagtgaactttcttgttggttaatcgtcaataattgcttagtgacatcttcaccaacagcgtgcttaattaaggtactgtttttccaattaaatagcatgcgccgcttatcatctaaactttccaaactaatataagttttcagttcgtggcttaactctttgaccacttttttctcgttaaacgagaagtgtttacttaggctatccaagtggcctcgattaactactttctcctgcatatttttatagccagctttggacttacgatagttcttaacttgttgattaaatgcctttctttcatgccgtttgctattgattccctcgtgttgcattggtgtgtcagctattccctgttccacaaatgatttttcactgatccgatcaggaatgtttttttgctctaaaacctgatttacacttgccgcccaattttgccgccattcagttattttttcttttttatcccaatcgaccatcagtatctttctactcttaggatacttgctagttccggtatatgttttgttgccattatcatctaaaatatattgctttttgctcttaattccccatgttccatctgaattaaacggccgattagttaacatcacatgagcgtgcggattatctgggtggtcgcgatgaattgccacgtcggctaccatgccctcatcaacaaaattttcttgcacatattttgtcagtaattctttctgttcggattcacttaattctaccggtaaagccacgttaaactcttttgcataccgtgagtttgatttacgatctttcttttcaacttcattccacaactgctctcgatcactcgcccattcaggtgaattttttggcgtcaaaataaagctttctggcatgatcgatcgggcataaaaatagtggcgaccttccttatcatcaaatagcttttcaccacttcgataagcggcactggcaatcgcacttcgtcctttaccagcactaatattactaaaactcatgtggaatattgccatgtcagtcacatgtctcaaagtaacttagaaaaacaagaagccaaattaaaacagcttaatcaaaagattaaagctgaaaaaaataaaattgaacaaaatctcggtaagcaaatcattagatcagccaatttggattatgggacacttaccactccacagattaaaatgattgctaaaaaagttgccgcctttttaaatcaagctcaaaataaccgataaatgcctaatcaatatgaaaaactagttgagcaacaagcgcgtttaaaacaaaaaattgagcgagaagattttaaattacggcaatctaaatactacgaaaatcggcaagcccgcaaagcccgttctcgccgattaattcaaaaaggggctttgctagaaaaatactttcaagctgataatctctcggttgaacaaaccgaagagcttttaaaaatatttgccgattacgttaatgcccataaaccaaataaactcaaaaacgatcaacctaataactagttatccgtttttttttagttgcttgtacatctggtttaattcattagcacttaattttttgtttgctctaatttgtaatccttgaatgccattgtcatatgtccaccgtttaattttagccatgtcattagttcgataataattggcaattagttcgttccattgatcccacttatctaacggcacattgattaagcctgcaccaccgtcaatcataattttattagcacttaaagtcgccgtccttttgttcccgtcccaaaagatttgttggcgcatattatgatacataacagtcaatgctttatcagtggtcgttgtttgcggatcagccaaaattttttgtaaaaaggattgttcttgtttttcgttaattaagggtggttcaaaaaagtcttcactgcctaaatcaactcctccttttccttgccgtaattctcctggtactaaggcgtcttccgcggccacaatcttgttaatttgtttttccatggttaacgttaaggaggaattttgagcagtgatatattgccacccacgctttaagttaacaattgtcaaaatatcttcaacaggaacgcctgccacactcatgccgtccataatggtttgtgtttgcggcaaagtggtatttacgccttcaaagcgggcactagtgtgtactagcttggtaaaatttgttcgagcaaaccgtttgttttctgcaactgtaaattgatacttgtccatatatgcttgtgtcttagtcattcaagaacgctcattgtcagtgttctgttcttcggggtgtttggccgcatattctctagccgcttgtttattccaccaaacgccaaataggttttgcatggtgccgtacaagtagttttccacgttcttgatatgcttttcattgcttcttagggcgttaaagtagcgtcttaaggctttagtcatcaaaggttttagttcttcgtcgtaaagcgggattatgacgccaatatcttgatgatccttttcaactcggtacttagcatttaagataataccaatgaagcgccgcatttgttgcggggtacggcaccaaaaactaagtagttgcacagcttcgggttctaagaaaaccggtaagccactgtcttcatcagttaagaagtcattagcatgatttatgagatcctggttttgtttttgaatttctgctggtgagaaattggctgtggaaaagtccaacttttgagtatctatattgtatctgattttgtctctttctttaggttctctatatagattaagtccattttttgaacttccgctcgtagcaagggtttgagagctgttgtcaacaaacttatgcggaagttcattttttgaacttccgctcgtagcaagggtttgagagcttttttgaccaaattcgccgcgtaaatagacatcggttgctttcacatcgagcttggacagatataagcgattcggttcatttttcttagttttcgggttaaagtccatttgtttctgaacgagtaatccgattgattccaactctgcttttattttgatgacttttccctttgaacaattgaacaagtccattagttcttgattggtaaagataaagtagacgtgtccttcactatcaacccagttattgcgcaaagaatactctaatcggtcttttagtaccatataggctaatttagcgtcattgcttaaatgcttgtattgctcgccatacatttactcccaggtgatagttgccccactagttttatatgctgttatggcacgtttactgcctagttgctcaaactgatcaaacatagtgctaaatacatagctatttaaatcctgtattgcacccaaccgtacttgttggacaattcgcattaaggcatcataaacaggttggtcgatgtcttcgtcttgtaaatcaaacaagctactttgtatctgatgactgtttaatgcttgttttttggcacgtagaattgttttttgaacagtacaaaacaattcaaaatctccgtttgataagagttttaaggctaaaagttgttgtttagaaaagatattgtcgttttctaattgcacttcaaacagcgcagcgtcttgtagctgcttgatattttgaggactgtccgttagagtatctgtttttttagtatctgtatttaaggttttaagatattcagtattattaatatcagtatcactagttaccgtttttcggtaatctagattactgtttttcagcaatctagatttatcaagggtttcaggctgtccatcattcatagatgttggtaaatcaatgtttacaacttcttctgcgagtggattttcagctgtttcaagttgatcgatgccataaatatcgttatcagtaatttccggtccaagtaaatacatacgatttgctttaccttgtcccatacgtttcataactaataattgggcctcagttaattcctttttgattgaagtgatttttgagtgtccgcaaccaagaatctgctctagttgttcgccagtgtaaataaaataaatattgccggctttatcgaaccaatggtttttgattgaaagttggaggcggtcagaaagaatggcgaaagcaagttttgcttcagcactcaattttttatatttgtcgtttgtcataaagaccttaggaacttggaagaatttaagtgcgtattcccgcttaatgttgtaatagttcagttgattatccatatgagcagtcgtgtaattacatttggtaatttcaaaggcggaactggaaagacaacaactagcacaatggtaggaattgaacttgcaagaagaaatttaaaaacgttattagtcgatcttgatcctcaagggaatgcaacaaacctttacttgaagacaaaagaaaacgttgacaacgaaatcgtatcatttaataaaacgttaatggctggtataaaagatcaagatttgagtcaaacaataattaatattttacctaaccttgatgtattaccatctagtgcagacttctcattatatccccgattcatggaaacagtaagtagcgattataatgaaagagtttggtacttttcgaaattaatgaaggaatttaaggaaaagtatgattatattttaattgatattccaccaacaatttcattgattacagacagtgcactatatgcttcagattattgtgtgattgttctacaaactcaggaaagatccttgcaaggggcagaagcatttattaactatatgcaagaacaagttattgatacatttaaggcaccaactctcgatctaattggaattcttccagtccttttaaaaaatggggctccagttgacaacagtactttagaggttgcaaaagagttatttggtagtgaaaatatttttgatattacaattaaaaatatggaacgacttaaacggtatgatgtgactggtgtaatgtttaaagatcagtttgatcatgcagtacagaatgtatatgaaaaagttacgactgaaatgattagtagaataggggctattgaaaatgggtagatgggtagtttattaaattcaaatagagtaaaatcaaatagtttagaccgtggaaagcgtattgaaccagagaactctatgagcataaaagatttaagtaatccaggcgaacaaagtaagagcagtaagattgagagcgtgacttattacgcgaatgtaagaattaataaccatataaaaaataaagcggaggctctttcaatcattggtgttgccaagtcacaaaaggacgcaattgatcgtgctttggattcttttgtagagcagttaagcgatgatgagaaaagaagttttaaaaatcaattagcaacgctggaagcaaaagatgtaaaaatgaaatctgaaaagtaattaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaaatgaacggttttagaaaaggatctattcgtaattttttaaaaatacctattaaaacgaattcaaaaataaatttttttgttagtcctcatagaaacatcacatggtactggaaaatcagaaatgtaggagaaactgcaaatagaaaagataacatccgtggacaaatcctcaaaggaacaaatcagcatactgaacctataaattttaagggtacccattatgtggaagcatacggattatctgaaaaaacagtagaatattttggtaaaattgaagtacggctcctatgtcaagaatctggacataaaagtacgaacaaatttgactttcaatttaaattacttaatttaattttcggaggccgaagttttagtcccgttcagattttaaaaacgctttagctacgctacaagtgaaatacgatcactgttataccaacgaatatagttatcaattccggcgattgcttcatgaattgtcttaaaatcttggaaattaacgtattcacgtttcaaaattgaatgaaaactttcaattcgcgcgttatcgccgggctgaccctttcgggagtaagaatgcttgataccatacttcgataaagtgttttcaaataagtcacttgtgtattggcttcccatatcactatgaataatttgtggtttaactgcttgcgtcatgacttgggtaataacgttagtcgctagttctttagtcatctgcgtattaagttggtaagcaataacccgtcgggttactggattatagacactagctaggtaacaccaagtatggttaaggggaatgtacgtaatatcagtcaataaaataccagattgatcagttaactgcttaatcaagtttggtcgctgatcataatcagtctgagtggttggcttattgattcgtttaaccattctagatctaatccctaattcacacatttgttgatagaccagacgctgactaacgtgaatatcagactgttgatttagtaagatcgttaatcgtgggtagccatacattggatatcttaaccaagccgttaacacttcttgtttaattaaatgccggcggcgttcagttctacttggctgccaatgtagataatcatagtaggttgagcgcggaattttgagtactgataagatacgcgtaatgcggtgcccagcaagtaaattagcgttgacgacttctaacacttagctttttgccatgagcaccgccgctcgttttaaaatatcaagttcttcttttaaccgtttattttctttaatcagagcacgttcatttgatgatagcactttagtgttgttaggatcagcttgtttaatccacttagtgaccgttgaaacactgacgttgtattctttagccagtgagttggccgaacggccagtctgacttaagctaacaatcgattctttaaattcatttgaatatttaattgccattcaatgggttgcactgttttgttctggtggtgtagtcattagtatcttcattttcagataggagccaatttcatcagattgattatcagtcatctaaaattcttttttcttcgtcttcacagtacataattctttataatatccattttccaatattaatttatcatgcgaacctgtttcaacaattccaccgtgatccataacgataatattttcagtttgcttagcaactgacaatcgatgtgcaacgaatattaatgttttgtcatttaaattcaataggttttcaattattcgctgctcagtaatagtgtccaaactactggttgattcatcaaacagtaaaacattagactctgtcagcagtgatcttgcaatagaaagtctttgtttttgacctactgagattgaactcccatgttcggaaatatctgtatcataccccataggaaaattttctatatctttatcaatttcggctatcctacatgcctctttcactttatcaatagataaatttcttttattctgcataataagattttctaaaattgtacctgcgaacattaccggttcctgtggtacatacgtaatcgattgtctcagggcatgacgatcaatgttatcgattaatttaccatttaataatatttgtcctgatccggcttgatagaaaccaaccattaattttgctaatgtggatttcccagaaccgctcataccaacaatcgttgtactactattcttttgtatttttatattgatgttgtgcaatacgttcgatccgtaaccataactaaattctacatcttgaaatacgatatccccatttaagtttgttgagctgtcgcgtccccccctattaaactcagaatccactaataatacttcatttagtctaatattagcgactcttgcagtttgtagctttggttgtaaattaataatattctctaagggatttaaaaagtatgttactaaagcattaaaagccaataatcttccgactgtgagattccccctcataacttggattgctccagcccataagataaagactataagaattagcttcaaacccacttttaaagcttgctgtccttggtcagctatcgtataccgtaaggaactgttaagaaaattttcgaatctatcagtgatttgattgtaggaaaattcttctgaagttaatgattttacagtttctatgccagttacgttttcgattattgcagaattcaataatgctgcattttccattgatttatggttcaggccattaaatgtatttttaaacgcataaattataactgagtacaccggtatagataccagagaaatcataaataactttgtatttaaaaatacgagaacgattgagattgtaaccaacatccaaacatctaaaaagagagtcaaaatcgtacttgccaaagcatctataatcttgcttgcatctgtaaaccgagagactatttcgccaactctacgtgttgagaagaaagacatgggtaattcaaaaaggtgattaatataatttaaaataatttttctagaaagattttgtccaaatatagttagtaaaaaattctgaaaatacgtcattacggcctgtaaaagataggctccaattaagcaaatcgagataatccccaatgtatccatatttttgtgtggtatatatatatctacaagttgttctaaaaaaagtgatcctgcaatactaattatcatcaatagtattgcggcgaaagctatccagaatattagggatttttgctgtctcaaaataggaataaacttgagtaaactgttatttctctgcttctctgaaacaaagttctttccttttgaaaatgttatgaaattacccgtccattcattttcaaaatcctttttggagatttccgtaattcctattgttgggtctgggtcaccaataattaaaaagtctttcgaaacatcaaatacaacgtagtaatgcagaacttttccttgctttaaaacatgtgcaatgattggtagcattaaattttcatctttaaagatgcccatatcagcttgtaatgcattcgcttctaaatttagttcctctgcagcctttatcagtccaaaaatagtagtcccttgttgactggtttttgctaagaatcgcaattttgatagtgaatattcggaaccaaaatttttaaaaatcatattcaaagctgcgattccacaatcatcttcatccacttgtgaacaatataattttttgtatctcaacagattaaacaaatgaagaatacacgtagcttaacgatccaagaaataaaatccatcacaggtggtaaatactatggtaatggtgttagctgtaactctcatggttgttcagtaaattgggggcaagcatggacttgtggggtaaatcatctagctaatggcggtcatggggtttgttaaatgaaaaacgcaaaaagcctaacaattcaagaaatgaaatctattacaggtggtaaatactatggtaatggcgttagctgtaactctcacggctgttcagtaaattgggggcaagcatggacttgtggagtaaaccatctagctaatggcggtcatggagtttgttaaatggcaaacaaagacaatattaaaactgaatctaaaaacaacatcgaagctctcttgcacttactagaaaagcgtcctgtaaaatccagtgaattactcgatattattgacgttctttcccaagtttatagcaaaattgatatagctaagaatcccgaagctttaattaatcgtcttgtacaatatatccgtagtgtgggaataaaaggtcgtcttcattttccgaaaaatgaagaaaggttaattattgatctaggttcaattggtcagaaagctggattaaatggtttgtacatggcagatttttcggataaatctcaattctacactatgtcagagcacataccaaaacactaaatgaatatgaaaaagaatttattttttttaataagtgtacttggactattatttttatttacggataataactcagttaaagcacaaactgcagttcaaaatagttcctctgaaaaagtggcacccatcgataacggagtggatcaagtaacttatgagcaaaatattcaaggaactacttctatttccttagatcaatatcttcaaaaggtggcaaacggggataaattcatcgtatacattggcttcaaggaatgcccacactgtcgtaatttctcacctgtcttaaaagaatttaccaagacggctaaacaaccagtttattatcttgattatggtccaactggttctttctcgacatcaactcaaacctcaattcaaaaattctataccacatttaatcaaccttttgaatttgctggtacaccaactgtagctcttttcaacaagacaaagttagtttctatggcggtcggagatgacacaacaataaatgatttggaccaaatactaagtgatagtttattaaattaattattcatcaatttccggcgccgacccaagctctgcctgaatcatccagattttcttctcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcatatgtttgaacaagcagttaactacaaaaatggactatatgaagaactatctaaaattggtaaagggctaagcagtgatcgacgattagaaattcttgatcttttaactcaagcacccaaatcagttgaaactattgccaacggggtcggaataagtgtagctaacgcctcacgccatctacaaatattgaaggacagtcatctggttaaaacaaaacgaaaaggcaatcatattatttatagccttagttctcccaaaattagtgatcttgtgcacctattaaccgatattggcaacagtgaactttcagatatgagaacaattcaggataaatcagacgctcaagataacgttaaaaccatttccttaaagcaagctcaagaagaatacaaaaattgctttgtccttgatgtacgaccttctgatgaatatgcagcaggccacatacaatcggcaattaatgtcccattggaaacattaaaagaatcaatgcccaaattacctaaagatcaaaaaattattgtttattgccgtggaagactatgtgataattccaacattgccacacagatcttaaatagaaatggttttgacgcagttagtttaaattcaagttactattattggaataaaataacagaataaatggttaagaacttaactgacaaagactttgtgaaagaaactagtaccggtgttacattaactgatttttgggctacttggtgtcctccatgtcgaatgcaaggaccgattattgaacaacttgataaagaaattggcgataaagtcaaaatcactaaaatggacgtagatgcaaatcaaaaaacaccaatggcatttggaattatgtctattccaaccttaattatcaaaaaagatggccaagtagttgataagctggttggcctccacagtaaggaccaactaaaaaccgttcttgctcaatatactaattagatggaacaactatcagtaatgaataaaaaagaatttgataaaaaactgaagaatggaaaatatattttagtttttatagcttcttggtgccctgattgtagctttatcaagcctcatctaccagaaattgaacaagaattcaaagattacactttcatcagtgtcgatcgtgatgagaataccgaattggctcaagaactaaatatctttggtattccaagcttcgttatttttagagatgggcaagaaatcggaagacttgtcaataaagatcggaagactaaagaagaagtcgaaaacttcattaccaacactattaactaaatgaagaattttttaactattcttggcggtatggggacgttagcaactgaaagttatgtccgactccttaataagaaaactgaaacccataaagaccaagaccatttagattatatagtggttaaccattattgaatgaggaaatatgatgtagtagtgattggggccggtcctggtggaatgaccgctgccttatatgcagcacgagctaatttaaatgtagcaatgcttgatcgcggtatttatggtggacaaatgaacaacaccgatgacattgaaaactaccctggttttacaacaattaagggtcctgaacttggtgagaaaatgtatcaaggaaccgttaaggccggagtaaattttgtatatggtgatgtccaaaacgttaccgttgatgatcaacaaatgaagcatattcaaaccgatagtgacgagttagtagcaagcgcagtaattattgcaacaggatctaataatcgaaaattaggtgtaccaggtgaagaaaagttctccggaaaaggggtttcttactgtgcagtatgtgatggttctttctttaaaggaaagaatgttactgtagttggcggtggtgattcagcaatttctgaaggattgtacttagctaatgtcactgatggagttaatgtcattcatcgtcgcgatcagttacgggcacaaaaggtattacaaaatcgtgcttttgataacgataagatagatttcacttggaatactagtgtgacagagattttaggtgatgaaaatcatgttactggagtaaaaattcataacaatcaggtcggtgatgatacaactctagacactgatggagttttcgtttatgtcggtaactttccaaatagccaaattttcaataatttaaatattaccgatcaagctggttggattataactaacgatcaaatggaaacaacaattcctggaatctatgcaattggtgatgtccggcaaaagcaactgcggcaaattacaactgcggttggcgatggtggtattgctgggcaaaacgcctttgaatatttcgaagccataaagcatcggcaaacggttaaagattaaatggaaatcaaatattggtcagacattgcttgccccttttgttatatcggttctaaccgaatgaaacgagcaatgaaggaaattggtatttatgacacaactgaattagagttcaaatcattcgagcttaaccctgcaacaccaaaggaaaccgatgaaggatacattaatcacttcactcagggaaataaggcaatggagccacaggccaaaaagcaaatggcttacatcgaacaaatggcgcataacgatggtctaccaatggatcttgacagtgtagtacctacaaatactatggatgcgcaccggattattaaattcgcagaagctaaaaatgatcctgatttgactgaacgagtaattagacgcttctaccaagtttactttagtgatggtcaatcgatttctgaccatgatgtgctattaaatgcggcaatggaagctgggcttgctaaagacgaagtagaaaaagtgcttaattctaaccaatatcatcaagctgtggtcaatgacgaggcagaggctcaacaatccggtattcatgctgcacctttttttgtaatcaataataagtatgcaattagtggtgcccaaccatatgaagtctttgttaaagccttaaagcgagttcaagaagaagaaaattagatgaccgaagataagccacaatttaatacaatatttggcgataataatgatgctgctgtatgtgggccagacggttgtaatatcgctgaacatcaaaagcaaactgaggataagaagaagaaaacaaaataaatgaagtttgactacgttgttattggcagtgggccatcagtttatcgtttcctattgggaatgcagaatagcggaaagaaaatcgcggttgttgaaaagaatcggtttggcggaatttgccctaacgaaggctgcgaacccaagattttcttagaaggagcagcacgagcaaccttaacttcaatgcgtttgcaaggtaagggaattactcaaccagctaagcttgactggaaagaacttattcagcaaaagaataaggctatggcgtcattcctaaataatatgcaaagtatgtatgaaggcctgggtgcgactaccatcaagggtgaagcatcatttgttgatcaacataccattgaagttaataataaaaaaatcactgctgataattttgtaatcgcaaccggaaaaaagccgcatcctcttaacattcctggccacgagtacctacttactagtactaacctttttgaactcgaagatactccaaagaacgtcgcaattatcggaagtggttacgttggtatggaatttgctacattgttgtctgctgccggggttaaagtaaccgttattgtccgatccggccaaccgctagagggattttacagccaacacgttcatcagttagttgatgaaatgaaaaactcacttggtattaattttatatttaacacaaatgttacagctgttaccgaagcacaaactggctatgaggttcaatcagctaacggcaaccttggcacttttgataaagttattaatgccagtggtagagttcctgaaattaatgcattgaaacttgataatgctggtgtagagtacagcaaccgcggaattaaagttgataaatatttgaccacatcagcaaataacatttacgcaatgggcgatattgttgataaaaccgcaccagcattaacctctacggcacagtttgaagcagactacttaagtgccttacttactaataaaacaactgaacctcttaggtacccagtaattggaaccgttacgttcacattcccccaactcgctcaagctggaattagtattgataaagcaaaggaagacagtaattattcaattaaagatattgatattactcaaggtgactttttttatgctggaacagatgatcacgcacgattatcattagtctttgacaagcaaaatcatctcgtgggcgctgctgaaattagccaaacagcagtagatgatatcaatgcactaattcctgttatggcaattgatgttgatccagaggtttggaaagaaaagatgctaatggctttccctggtttagcatataaaattagaacattaatttaattatattatttctgcttcaataatttttatatctttttcataatctctttctgaataattctgttcaaatccccttaataactctgaatttagtttcttagctgacatttccattctaatcatagttatacttcccgaagtaaccccaccaacgactggaacaattttcgcaattccagaggctagtccctttttggttagtgttttgccagcaactatactagttattttttttaataatgggtaccacaaagttttcatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccaccgtaaagctgtacaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatctccgatgcgcttacgttgattaatcatcatgggacgctgttcaattgatcgccccaaagattgatgatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcctagacgtaaatggttgaaaattttttgctttgactcatcgctcagcttagttttccgaccacatcgggattgcttgtattcggcatctgtttgtgctaattcagcctgataaggttgacatcgagataattcataagaaattgttgacggtgatcggttcagccgaacgcccatttggctattggacagccctagttcacaaaaggtttcgattttaattcgttcggaataggttatactagacaattagaagtcatagtcgccgctactcatagcttcagcattacccattagatagccagcaccaacttgtgaaaagaaatcatgattggccgtttcggttgaaattccgttcattacgattgggttgatatctttaatctcagcattggggaagcgagattcgaagcccatattttggagcgccttgttggcgttgtagtgaacgaattgtttaacgtcttctgctaaaccaatcggcgcgtagacttcttcggtgaacgcaaactcattctcaaggagatcatcgagcaactcatccatccactttttgaatgttttttgttcagtcgccgatagctcgttatatcccaattgaaatttgtagccgaggtaggtaccatgaacagattcatcgcggatcaccagtttgataacttcagaaagatttgccagcttattgttaccacggtaccaaagtggggtaaaaaagttggtgtagtacaaaattccttcaagaaagacgcttgcaactttcttttcaaggttgtttcccgtttgataaatatcattgatccgtttggctttgtattgcattctgggattattgttcatccatttgaatacttcgtcaacagtggcttgatcgttcaaagatgtcaaaatagtgccgtagcttttggcatgaattgactccatcatcaaaaagtcattgaggactgctgcttcttttcgtgtccgaacgtcgggccgcagcacgtcgactccttcttcggattggagtgtgtccagcaaggctaatccacccacaacccgattgataaccgatttttcggtgccagagagtgtccgccagtcccgtaaatcattagaaacaggtactcgcgtatccagccagtattgtgccgttgctttatcccatacatattcgtcaagttcgtcttcgatgacgtcccaattaattgttttatagctcatttaaaagtcgtagtcgttatcggtcattttttcagtgtccgattcattgtttgcagccgttacctgttgcaaaaattgattttggtcaatcatcagttctttgagttgcgccactagtgaagacggttgaacttcgtagacagcgttaaagccaagtgacattaatgcatgattggcaccataggaggccagattgatggcttcggtggcatcgtcaaggttagcttctaagaagtctttttcagtttgcatgagttgatcaaactgtgtattaatccaatactgcagttcggtttgatcacttacagtgagttcttcaaatctgaggcgaaatttgtaaccaatataagcactaaaaagagcgctaccgcggagaatattagccaacatttggtaagtattgacgagatcctgtgtttgaagtattgtccagtatttaccaaacgagagcccagtttcagtcagaataaaaagggcttttttctgtaaggccatatcgctagtgctcgtttgggctagttggtcaatttcagcttgcagattggcattatcatctgcccaagtaaaacttccaccatcgttacccggaatcagagcccgaaaaatggtcgtacagcttttggcatggactgatttcataaaggtaatggtgtttaatacggattcttcttgttgagttctccgatcgtggcgaatagcaggggtgccaacttctgattggtagacggctaacattgatgtacctgccaacatacgagtaatggcctgttgttgagtatctgatagctgttgccaatccgtttgatcattcgtgatgggaatccgaatgtccaaccaaaagttagtggtgagtcgttcccacatgtatttatcgaaattatctttaatatcatcccagttaattgctttgtagtataaatagtccatctagatcatgcatgattcacattcatttgccgttttaatttcatcgtcttctgtaaacgttcgaatgtaataaagtgacttaatgccttttgtccaggcgtaattccgtaaccggttaaggtctcgggttgtcatctttaaattgttattgtccttccactcgtaaaggtcaggtttcaaaactgaacgcataaatagtgtcagactcataccttgatcaatgtgcttttgagctacggcataggtgtcaataatttttcgttgatcaatatcatatgcgggtgtgtagtaaggcaaagtttcgttagacaggtaaggtgctggatagaagattgagcctaccttattttcctgacgttgttctactaattgtgtgattggatgaagtgatgcacttgtttcattgacgtacgaaattgacccgttcggtgccacagcgagtctattacgatgataaaggccgccagtaatcacagcttgcttgagtgccttccaatctgtaacagatggtaatttaatatttttgaagatttttgcaactttggtactcttaaattcaaagtctgcgttcaagtattgatcgaagtaactgccatcagcgtactttgattggtcaaatttagcgaaggtttcgtggcgttcacgggcaattcgattgctcgtaacgagtgaatagtagtttaaagctaggaagtaggcatcagtaaattcaagggcctctggtgagccatactcaatttggtggcgtgcaagggcagtatgcagacccatagcccctaatccaatcgtgtggtaaagttcgttaccatgtttaacagtcggtacttccttaacgtcggttgtgtcagttacgagggtgagcgcacgaacagcaacctcaactgagtgaccgaagtccggcgagtcaatcatattcatgatattagttgatccgagattacatgaaatatcggtgccaattgtcttgtacgataggtcatcatcaagttttgacggttcttgaggctgtaagatctcactacaaaggttactcataataattttgccatcgacagggttagtttgattggccgtatcaatgttcaagatgtaaggataaccagattcttgttggagttgagaaatcttttgttctagtttccgcgcgttaaagactgacttcttaatattggggttagcgaccatgttgttatattctttggtgatatcgatgtaagcaaatggcgtacgatattcacgttcgacatcataggggctaaaaagatacattggttcgttagtcttgagtaattcataatatttatcaggaacaatcaaaccgagggacaaggtcttcacccgaattttttcgtccgcattttcctttttggtatccagaaaatgtaagatgtcaggatggaagacgttgagataaaccactccggcgccgttccgttgcccaagttggttactgtagctaaatgagtcttcaagtaacttcatcactggtataacgccagacgaggcgttggaaatctgcttaataggatcacctgaggcgcgcaagtttgacaggttaacgccgacgcccccaccgattcgagatagttgaagggcagaattaacgccacgtccaattgagagcatggagtcggccacatcgattaaaaaacatgataccatttcaccgcgccgttttttacccgcgttgagaaacgtgggggtggcaggctgataacgttgtgaaatcaattcatcggcaacgtcattggcaagttgttcatcaccattagcgagatagagggcattgaagacgacgcgatcgacaaagtcttccaaaaattgctggccatcattagttttcatggcatattgtgtgtagaacttgtaggcaccgagaaagctgcgaaaacgaaagtgatggtctctcatttggtcgaacaaggactgcacaaacttgtgagagtattgttccaggatacttggatcgatataatcttcgtcaaccaagtaatttaacttggcatttaacgaatcaaattgctcggtcttcggtttaactgtctcttcgaaataagcctttagggcttcttgatcataatgtagcggaatttctccgttgcttgggatatttactaggttatttaagtaaaaataggtattttccatttctggggtgctagttaccatttactcctttgttgtttgaaaacagaattgatcgcgataggttaagatggcatcggcaatgcgaggaatgtcgtgtacggtgccacgtagctcaaaatcggtaatgtaaggaaaaccgaagcgtttagcatattgtttagccgtgagtgcaaactgcttattaaaattacgattaccgctaccgataataccgtagcaatgctggtaattgccttcgtacgcgaggtaatctcccaaaatagtagttaatatttcagtataaccgttattaaccccattaccacctttaataaaggctggtaggaaggtaacaaacggctggtcaagagtggtgaattcagggtgttctttaacattaatggaactaacctgaacatgacgttctttctcaaagtatgttgtcagtctgctaataaaatattttgtgttgccactcaattaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgcctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaagcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaatcaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaatcaatgcacatcgaatttctttcggtatctgataaaggttgtccgtttaatcccggtattacgggcaacatctacatcactcatgcccgtctggtaaagtttaaaagcatgtagtaaacggggatcatcttcggcatattgaggtttccgaccatgatatttaccctgctgtttagcgagggcaatcccttgttgctgccgttcaatgatccgcttacgttcgctttcagcttgatatttatacagttcaataatgagattcgtcatgagctggcgtaaattaggatccgcaatccctgtcatggacggcaagtttaacacatctagggtggcccccttattttgaatggtgttcatgatcttagttaagtcctggttgtttcggcctaagcgatctaattcagtgaccaggacaatatcaccctcgcgaacataggcgagcattttttgcagttctggccgattagtgttagctccacttaatttatccgtaaataatttatcaacgccttttaaggccgctagctgtcgatctaaatgttgctctttggaactcacacgagcataaccaattttagccatatgcctgatcttcaggaactttggaattatctgcaagaaaaattccaaaccgatttaaccacggttggctttaacgcttggattaaaaccgctaagccgcttgcttttagagctaacgaactactaattgaagtgccttctgtcttgcacaaagaatactgggaaaataatttagcgactaaagtcgttgaaggggcctatgagtttgcggaaatcgagctgacccctatttttgtgttacctggtgaatctgacaacttaacaccgcttgaaccagaagaagaacacgttttaacgaaggctgaaacaccaacctttttacgtgaaacgcatttaaatagtaaatatacatttgatacgtttgtcactgggaaaggcaatcaaatggcccacgctgcggcgttggtggtttccgaagaacccggtgtcttatacaatcccctcttcttatatggtggtgttggtttaggtaaaacccatttgatgcaagcgattggtcaccaattactcgaatcaaaacccgaaacgaacgttaaatacgtgacgagtgaggcttttgccaacgattttatcaattcgattcaaacgaagaatcaagagaaatttagacaagaataccgaaacgtcgaccttttattagtggatgatattcaatttttcgctgataaagaagggacgcaagaagaattcttccatacgtttaatgatctctataatgataagaaacaaattgtgttgacctctgatcgcctcccaaatgagattcccaagctgcaagaacgcttggtttctcggtttaaatgggggttaccagtcgatatcacgccacctgatcttgagacgcgaattgcgattttaagaaataaagccgatgcggaacatctggaaattccagaagatacgctcagttatattgctggtcaaatcgattccaacgtccgggaattagaaggcgcactcgtgcgggtccaggcctacgcaacaatgcaaaacgctgagattacaacgagtttagcggccgacgcgctcaaaggcttgaaactcaacggtaaatctagtcagctctcgattgccaagattcaatcggtggttgctaaatattacagcttaaccgttgccgatcttaaaggtcgcaagcgggtcaaagagattgtgttgccgcgccaaatcgcaatgtaccttgctcgcgaaatgaccgacagctcattacctaaaattggccaagagtttggcggtaaagatcatacgaccgtcatgcatgctcatgaacggattagtcaaagtttgacaaccgatcaaaatctaaaagatgccattttggatttgaagaacaccatgaagtcttaaatgaaattttcaattaaccgcgccctatttatcaaaacgctcaatgatgtgcaacgggctatttcagctaaaacaacgattccaatcctaacagggcttaaactggttctatcgcaagaaggcttgacgctaaccggtagtgatgcggatatctcaattgaagcaacattgtcagcctcagatgaaaaaaaccaattagtcgtcgaagaagttggcgaaattgtgttaccagcacgtttctttagtgaaatcgttaaaaaattaccagaagatcagatgcgaattgcagttggaaataatttccaaacaacaattcgctccggtaaatcagaatttacaatcaacgggttagacgctaatagttatccacaccttcctgaaattgcagggcaaaatacatttagcatcagtaccgatgttttgaaacaactcattcaccaaactgtcatcgccgtttctaatcaagaaagtcgcccaatcttaactggggtccacttggtcctagccaatggcgaaatgttagccgttgcgactgatagccatcgtttagcacaacggaaattaacagttgcgcttccaagtgatgccaattatgacgtcatcattcctggtaagagtttggtagaactttcaagaacgcttgcggatgatgccgaagacgttgaaattcggattgctgaaaaccaagtcctctttaaagctggcaacttagccttttattcacgcttgttagaaggtaactatcctgatacagcacgcttaattccaacgtcatcaagtacccaaatcgaatttaacgcgccagtcttattggccgctatcgaacgggcgtcattgttatcccatgaaagtcggaacaacgttgtccgtttaacactcgacacagacgctaacacagcgattatctatggtaattcaccagatgtggggaatgttgaagaagcccttcaatttgaaaacctcacgggtgaatcccttgaaatttcatttaaccctgactacatgaaggatgccttgcgttcatttggccaaacaacaatcgtgattaactttacggctgctttacgaccatttacgttggtgccaagtgaagatcaagaacactatattcaattgatcacaccagtccggacattctaaatgacacaagaaattaaacttgaggctgaattcgtcacattaggacaactcctaaaagaagccggcattattgaaacgggtggcaaagccaaatggttcctaagagaaaatacggttttagtcaacggcgaacctgatgatcgacgtggccggaagttatatccagaggatgtcattgaagtcccagataacggccaattcatcgttaaacaacaagaaagattgtagatgtatctaagcgaactacaactgaatcattatcgtaattatgagtcagttgatgtgcacttttcaccggatacgaacgtcttgattggtgaaaatgcgcaggggaaaacgaacttactagaagcaatctacgttttagccttggcccgctcacatcgcacgaataccgatcgcgaattaattcaatggcatgaagacttcgctaaaattaccggtttggtccaacgttctgcagggaaaaccccgttagaactcgttttaagccaaaaaggtaaaaaggcgaaggtcaatcatttagaacaggccaagttatcacaatatattggtcagctaaacgtcgtgttatttgcgccggaggatttaaacatcgttaagggttcgcccgctgtgagacgtcatttcattgatatggaattcgggcagatgagtagcaagtatctctataatatttcgcaatacaaatcaattctgaaacaacgtaatcaatatcttaagcaactccaacggcgccaagccaaggatcttgtttatttaggtgttttatcggatcaattagcggcttacggggcggaagtgaccgtggcccggcgccagtttctccaacaaatggaaaaatgggcccaaaaattgcatcaggagattacgaaggatcgggaagtcttgacgtttaaatatcaaagtcaaattccagaagaacaattagatcaaagtgtcgaagaactctatcaacaatttcaaaccttgtatgagaaacaacaaacccgtgaggttgaacaaggcacgacgttgattggtccccaccgcgatgatgttcaatttttagtcaacgataaggatgtgcaggcctttggttctcaagggcaacaacggacaaccgcgttgagtgtcaaattggccgaaattgacttgatgaaggcccaaaccggggaatacccgattttattactggacgatgtgttgtcggaattagacgatttacgccaaacacatttgttgaagacgttccaaaacaaagtccaaacattcctcacaacaaccagtttagagaatgttaaaaaagaaattattgcgacgccgcgcgtgtttacagtcaccaacggggtcgtcacagaagaacaagcagaatagttggcagatgatcaattgaacaaagaaacagaagcccaaattgaggcaaaagaagaacgggccaaatcttatgatgcgagccaaattcaagtcttagaaggactcgaagcggttcgtaaacgaccagggatgtacattgggacaacgagttctcaagggttacatcatttggtttgggaaattattgataacgggattgatgaagcgctcgctgggtttgcgactgaaattaacgttgttgttgaacctgataatagtattacggtgaccgatgatggccgggggattccagttgggattcaagctaaaacgggtaaatcagcgctagaaaccgtctttacgattttgcatgccggtggtaaatttggcggcggcgggtacaaagtttctggtgggttgcatggtgttggggcctcagtcgttaatgccttgtcaaccgaattagatgccgttgttacacaaggtggcaagcggtactacatcgatttcaaacgtgggaaagttcaaacaccaatgaaaatgatcggcgacgcgcccgaacatgaacatgggactaaagtccatttcgtgccagatcctgatattttcacggaaacgacaatctatgacgataaaattttaacgactcggattcgcgaattagcattcttgaataagggcttaaaactaacgtttaccgacaaacgggctgatacccatgaaaagcttgaattccactatgaaggtgggattaagagttacgttgaattcttagacgaaaagaaggaaacactccttgatgaaccaatctatgttgaaggcgaacaaaacgggattaccgttgaagtggcgcttcaatatacgaatgattatcggaccaatttgttaacatttgccaacaatatccatacctacgaaggtgggacgcatgaatccggctttaagacggctttaacgcgggtcattaacgactacgcaacaaagcaaaatattttcaaagcaagtgatgcgaacctttcaggggaagatgttcgtgaagggttaacggctgttgtctcagttaaacatccagatcctcaattcgaaggtcaaactaagacgaagttaggaaatgcggatgctcgttcagttactgatcggatgttctcagatcactttacgaagttcttgatggaaaacccatcaatcgctcgtcaaatcgttgataaaggctcattggctgctagagcacgtttagctgctaaacgcgcgcgtgaagttacacggaagaaaaatggtcttgaaatctctaatttacctggtaagttagccgataacagtagtaaagatcctgaaatctcagaattattcatcgtcgaaggggattctgccggcggttcagcgaaatcaggtcgttcacgtttaacgcaagctatcttgccaattcgtgggaaaatcttgaacgttgaaaaagctagcatggaaaaaatcttagcgaatgaagaaattcggacgctctttacggccatgggaacaggctttggacaagaattcgatgtcgaaaaggcccgttatcataaattgattatcatgaccgatgccgatgtcgatggcgctcatatccggacgttattattgacgttattctatcgttacatgcgcccaatcgttgaagctggctacgtctatatcgcgcaaccacctttgtaccgggttaaacaaggtaagatgatgcgctatatcgattctgatgaagaattgcaagatgtcttaggcaccctacaaccaagtcctaaaccggaagtacaacgttacaaagggttaggtgaaatggatgccagccaattatgggaaacaacgatggatcctgaaaacagacggatgctccgcgttaacgtggaagatgctgaagaagcggatcaaatttttgaaatgttaatgggtgatcgtgttgaaccacgacgtctattcatcgaagaaaatgccgtatacatggatccaaagagtattgatgcgtagatggcaaacgaaaatggccaagatggtcggattgaaaacgtcaatttatctaaaacaatgcgtaaatcattccttgaatacgcaatgagtgtcattgttgcccgtgctttaccagacgttcgtgatggtttaaagcccgtacaacgccgtattttatacgggatgagtgaattaggggttacccctgaaaaaccttataagaagtccgccagaatcgttggggacgttatggggaagtaccatccacatggtgattcagcaatttatgaagcaatggtgcggatggcgcaagaatttagttatcgttacatgttagttgatggtcatgggaactttgggtctgtcgatggtgatggcgcggctgcgatgcgttataccgaagcccggatgagtaaaatggctgttgaaatgttacgcgatatcaacaaaaatacaatcgattatgtgcctaactacgatgaatcagaacgcgaacccgctgttttaccagcgcgcttcccgaacctgttagtcaatggggcaaccgggattgcggtcggtatgacgaccaatattccacctcataatttggctgaagtgatcagtgccatccatattttgatggataatcctgatgcaacaaccgccgatttgatggatgctttaccaggacctgacttcccaactggtgggttagtaatgggtaaatctggcattcgtcatgcgtatgaatccggcaaagggacgattacgttacgggccaaagtcgatgttgaagttaagaaaaacggtcgcgaacggattatcgtgactgaaattccttacatggtcaacaaagcaaaattggtcgaaagaattgccgaattagcacgggacaagcgtcttgaaggaatcaccgatttaaacgatgaatctgatcgtgacgggatgcggattgtgattgatgttcgccgtgatatgagtgcttcagtgattttaaataatctctacaaactcacaccattacaaacctcattctcattcaacatggtggccatcgttaacggtgccccaaaagtcttaagcttaaaatcaattcttgaacactacttagtgcatcaagaagaagtgattcgtcgtcggactgaatttgatttgaagaaagccgaagcaagagctcatatcttggccggtttgcgaattgcattggatcatatcgatgctattattcaaatcatccggagttcaaagactggcgataccgctaaagtcttgttgatggaacgttatgacttatctgacaaacaagcccaagctattttggatatgcgactcgttcgtttaaccggtttggaacgtgacaaagttgaaaatgaatacaataatttgatggcgttgatcactgatttgaaagatatcttagccaaaccagaacggattaagaaaattatttatgatgaattgttagaaattcaaagtaaatttggcgacaaacgtcggactgaattattggtcggcgaagtcctcagtatcgaagatgaagacctaatcgaagaagaagatgttgtgattgctttaacgcataatggctacatcaaacgcttgccagcgagtgaatttaaagttcaaaatcgtggcggccgtgggattcaagggatgggtgttcacgatgatgatttcatcgaacacttaatctcaacttcaacgcatgaagtgctcctcttctttacgaatactgggaaagtttaccgtgctaaagggtatgaaattccagaatacggtcgaacagccaaggggattccaattattaatctcttagggattaattcggatgaacgtgttcaaactgtggttaatatcggtaaggaagtcaagcctgaacaagccttgttcttcattacccgcttagggacggttaaacggacggccgttggcgaatttgccaatatccggagcaacggtctgaaagcactgaccttgcatgaagatgatgagttgagcaacgtcttaatgactgatggtcaacaaaacatctttatcgggacgcataatggttacgccgtttccttcagcgaaacagccgttcgttcaatgggtcggacagcagccggcgttcgtgggattcgtctacgcgaaggcgactatgttgttggttctgacttgttgattccgggccaagaaatcttagtgatttctgaaaaaggttacgggaaacgaacagccgttagcgattacccaatcaagggtcgtggtggtaaagggattaagactgccaatatcactgaaaagaatggcccattagccgggattgcagcagtaactggtgaagaagatattctcttgattactgatactggcgtcttgattcgtttcaaggtggctaacgtgtcacaaaccggtcgggcaacacttggtgtgcgcttgatccgtgtggatgacgaagcgaaggtggcaacaatggccaaagtcgaagctgaaccagatgaacctgaaacacaaactgcaacgactgaaccaacagtgccaactgagaacgtaacggacactggcttagcacaagttgatgatttattagcccgtgctgaagagaatcaaaacgaaccaaataacgactaaatggctcaatcaaaatacgaagttacttatatcatctcaacaacacttgatgaagaaagtaaaacagcccttgtcaaccgtttcgacggcatcttaaaagacaacggtgctgaagtggttgattcaaaagactggtcaaaacgtcgtttagcttatgaaatcaacaatcaacacgaaggcatttaccatatcgtaaatgttttagctgataatgatgaagctttaaacgaatttgatcgtctagctaagattgatggcgcaattttacgtcatatgatcgttaaacgcgaagactaaatgattaatcgagttgtactcgttggtcggctaacacgcgatgttgacttacgttacacttctagtggtgctgcagttgggactttctcaatggcagttaaccgtcaattcacgaacgctaacggcgatcgtgaagcagactttattaattgtgtcatttggcgtaaatcagcggaaaatttcgctaactttactaaaaagggctcattagtaggggttgatggccgtctacaaactagaaattatgaaaatcaacaaggtcaacgtgtctacgtgactgaagtggttgtcgataatttctcattgttagaatcacggacaacaacagagcaacggcaaggtgatggcgcaagtcagaactttaatagtaatcaaagcaatggtagccaacaatctggatttaccagccctcaacaaacgggtaacgcaccagccgcaaataacactcaagccgatccatttgcaaataatggtcaagcgattgatatttcggatgatgacttacctttctaaatggctcaacaaagaagaggcggcaaccgtcgtcgtcgtaaggttgatttcatcgctgctaaccacatcgaatatatcgactacaaagacactgatttattgaaacgttttatctcagaacgtggtaagattttacctcgtcgggtatctggtacaagtgctaagaaccaacgtcgtttgacaattgcaatcaaacgcgcacggatcatgggcttattaccattcgttacagaagactaaatgaaaaataaaattaagcaattaaaattaccgcagtttttagatgatgcgcgcttgcggatggtggccctagtcttattagggttgaccgccgtcagcctgatctttgcagcgatgttaaattggctcatcgctttgattttgttcgtgctcttaattgggaccttaatcaccgtcttgtacgcgattgagacggtcacggaaaatactgccaagtatgtttcggatttgtcctaccggattaaacggggcgaacaagaggccttaatcaagatgccaatcggaattttgctctacaatgaaaaaggcgaaattcaatggaccaatccctatttacaacaatacttggggaataaggaagtccttggaaaaacgattaaagaagtcgatccggaattggccgaattagtcgtccaaaatgaagattccaacgaaactaagctcgttcactggggcgataatcaattccagattatcattcaagaaagtatcggggtggtttaccttctcgatatcacgcgttatgcggcgattgaagatcgttatgaagacgaacaggttgcaatcggccaagtctttttagataattatgacgaaatcacccaaacaatggatgatcaagctatttctaatctgaataactacgtcactaacgagctctctcggtgggctaatcagttccaaatgttcttaaaacgggttgatgatgatcatttcttcgtcctcgcctacgccaagtcgctccacgcggctgaaaaagagaagtttaagattctcgatgagattcgtgaagaaacttcaaaacaaaacttcccgttaaccttgagtgttggctttgcctatggggaatctgatttagccgttttagcgacgacttctcagagtaatttagatttagcacttggccgtggtggtgatcaggtggtcgttaaggccaacgatgggcaagcccggttctacggtggtaaaacgaacccgatggaaaaacggactcgagtgcgtgcgcgcatgatttcgcaagccttgcaggaagttttcaagcaggtcgattcaatctttgtcatggggcatattcggcctgatatggatgcgctcggtgcgtcctttgggattcggcggattgctgaaatgaacggcaagaaatgttatgtcgtggttgatcaaaacaatattcataccgatattcaacgtttgttggaagaggttaagggttatccggaaattgcagtcgaagtcctttcccctgaagaagcagtggaaaaggcaacggctaacagtttattagtaatggttgatcattccaaaccatcgattacgatggcgcctaaattgtatgagaaattggcgcaacggacaattgtgcttgatcaccatcgtcggggggaagagttcccagaaaacccaatgttggtttatatcgaaccctacgcctcttcaacgtgtgagttagtgactgaaatgtttgaataccaaccacaaaacgtggccaacattaacaagtttgaagcaaccacgatgttagccgggattacggttgatacgcagtcgttttcaatgcggaccgggacgcggacgtttgatgccgctagttatttgcggtctgtcggagcggacgcatcaatggtccaacatctgttaaaagaaaacgtcgataattatattcaaaagaatcatttgattgaaaccattgaaatggttgaggacaatatggcattatgtatgggggaagacaatcgcagttatgatcccgtcattgcagctcaagcagctgataccctcttgtcgttatctggcattgaagcggcctttgttattgtgaaacgcccagacggcatgattgccatctcggcacgcagtttaggggacgtcaatgttcaagtgattatggaaaaattgggtggcggtggtcacttatccaacgcggcaacccaattgaaggatgcgacggtttcagaagccaaagctaagttattagccgttctggccgaattatttgatccagaagaagcggaagaaaacgcaactaacgattaaatgaaagttatttttttagaagacgtacgcggtaaaggtaaaaagggccaagtgaaagacgtaccagatggttacgcacaaaacttcttaattaaaaacggtaaggctaaaccagcgacaacagctgctgtcagtgctttaaaaggccaacaatacgctgaagctaagaatgccgctgctgaattagcagaagctaaggttttaaagacgaagattgaagacgataaaacaatcgttgaagtgaagtctaaagctggcgaagacagccgtttattcggttcaattccaagcaaacaaatcgcacaagccttagaacaacaatacaaaatcaaagttgataaacgtaaaattgatttaccagaaccaatcaaagcgcttggttatcgcaatgttgacgtccggattcacccagatgtaacagcgacaatccgggtgcacatcgtcgcagaataaatggtgaataatgaactaatcgaacatacgccaccgcagaataatgaagcggaacaggcggttttaggcgctgttttcattaatagcgacgcattagttgaagcgatggaatacgtgactgccgatgatttctatcgtaaggcgcaccgcctaatcttcgaaacgatggttgaactgaatgaacgggtcgaaggcattgatgcggtgacgatcaagagtgaacttgatgcccgcaatcaattggaagatatcggtgggattggctatttggctgaattagccgatgcagtaccaaccgcagccaacgtggtttattacgcgaagattgtctctgaaaaagcgatgcttagacgcttaattcaaacggcacaaaatattgtcgccaagggttacgcgcaagacgaagatgtaacggatattttggatacggctgaacaagaaatcatggcggtttctgaacagcaaaataaagccggcttcaaatcaatttcagacgtcctaaccacgtcgattgaacatatcgataagctctatcaagaagaagaaagtattaccggtctttcaacgggctatccagacctcgataagatcacggctggcttgcatgaagatgaattgatcatcttagcggctcgtcctggggttgggaagaccgcctttgtcttgaatatcgcacaaaatatcggcaaaatgaccaacgaaaacgtcgctatttttagtttggaaatgggtgccgaacaactggttaaccggatgttgtgtgcagaaggcagtattgatgccaaccatttaagaaccggtcaattagaagaatcagaatggcaaaatctgattattgcgatgggcagtttgtcgaaagccaatatttatatcgatgatacacccggcgtgaaaatggctgaaattcgggctaaatgtcggcgtttagcgaaggaaaaagatggtattggcctaatcgtggtcgattacttgcaactgattgaaggttccggtcaagaaaaccggcaacaagaagtttcagcaatctcacggcaattgaaaaagttagcgaaggaattacgggttcccgtaattgccttatcacaactttctcgtggcgtggaacaacgtcaggataaacgaccagtattatctgatattcgtgaatcaggatcaatcgaacaagatgccgatatcgtggctttcttgtatcgtgatgattattatcgcgatgaaccaggtgaagacggcgaagatggtggcggtcaaccagcaccagatccggaaaatgcggatgtcggtgaggtcgaagtaattatcgaaaaaaaccgggccggcgcgcggggcacggtaaagctgttattcgttaaaacctataataagttctcgtcgatatcgtattcgcaaggtgaatactaattattgttgatgttttgcttcaattaacgagcggtagttaacaaggaggtttaagatcaccgctgttaaactgccgacaactaagccgttaccaagaatggtttggacactagctggtaaagcttgtagtaaggttgggtgaatagcaatcccaaggcccataccgattgaaagggttgcgactaagaggttacggttgtcttcaagatcaaccttgtggagcattttaatcccttgaatcccaacaatcccaaacatgacgaccattgcgccccctaaaactgaggttggaataatcgtggcaaccgcaccaatcttaggtaagagacccaagaagatgaggaagaaagctgaatagtaaacaggtttctttgttttgatgcctgataattgcacaatcccaacgttttgagagaaggttgaataagggaaggtattgaacaggccacctaagattgcggctaatccttcagcgcggaaaccgcgttttaagtcattacttgtgatattacgaccgacgatttcgccaagtgcgaagaaaacaccgattgattcgatcatcgtggttaaggctgccaatgacatagatgcgattgacgtccattcaaaccgtggtgtaccgaagtagaaaagttctggtagtttaaaccagctagcttggccaactggatcaagtgaaaccaatccgacagcagcgccgactaatgttccaccgataatgccgattaaaattgcaatttgttgaatgaagccgcggccccaaatgctaaaaattaaaatcagaacaatcgttgaaaaaccagcgattaagttggggacgctcccaaatgacttagcagtaatatcgccaccaccaagattttggaaggcaactggaattaaagtgaagccgattaaagtaattaatgaaccagtaacgattggtgggaataaccagcgtaagcgggcaaccacaccagaaattaagaggatgaagaccccagcgccgataatactaccgtacatgacgtcaatccctaattgactgttagtcccgatagcggttagtggaccgacgtattcgaccgcacagcccaagacgacgggtaaagcaatcccggttaaaggtgttcgtttcaattggagtaacgtggcgatcccacacatgaaaatatcgacagagacaaggtaagtcatctgtgcggcgttaaagtgaagtgctgcgccgactaataatggaattaagacgtcaccagaatacattgctagaagatgttgcaggcctaaaatggccgctttaatatgagaaagctttggagcgggttcaatagtacgtgctgagtcggactggaaatctgccacatgacaccaaagacatttgtcgcgacattgaaagaacatcaaattgatgtttcacaaaaacaattagaccagtttgagatttatttcgaacggttagtggctaccaatcaaaacgttaatttaacggcgattacagagaaagaagccgtttatttaaaacacttctttgattcggtggcaccaaccttatacttggaatcattgagaacgatgcccctcaatatttgtgatatcggtgccggtgccgggttcccatcattaccgatgaaaatcttgttccctcaattaaaggtgacgattgttgattcattaaataaacggattcactttctagaagaattagtggccgaattagggttaactgatgtgacactcgtgcatgatcgggctgaattattcagccaagtcaagcacccatatcgcgaacaatttgatatggtgacagctcgtgcggtcgccccaatgaacgttttagcggaattctgtttacccgctgttaaagtgggtgggcagttcgttgctttaaaggcgagtcaaagtgacactgaattagcggaagccgcttttgcaattgagacgttaggtggtcagttaaaagaagatatcgcgtttaacttacccgaaactaacgatcccagacatttagtaattatcgataaggttcaatcaaccccagataaatatccacggcgcgcaggtgtgccggttaaaaaaccattaatggctaaggaggagaaataaatggcaatttcattttttggtaagaaaaaagaagaaacaagttcaagtgttaatcaggtggtaatggtaccagttgctgcgatcgtaccgaaccgtttccaaccacggaaggtttttaataccgatcacattggtgaattggcaagcaccatcgaacaacatggtttattacaaccaattgttttaagagaatatgaagatcaaaagtttgaaatcatcgctggtgaacggcgttttagagccattcaaaccttgaaatgggctgaattaccagcaatcgttcaaaagatggatgatcatgaaacagcttcaatggccttgattgaaaacctccaacgggaagaattaacggcagttgaagaagcagatgcttaccaaaacctcatgaagttaaacggctttacacaagctagcttggctgaaaaaatgggtaagagtcaatcgtttgtcgctaataaattacgactattgaagctctcacaaccggttcaagaagccatcatgaatcatgaaatttcagaacgtcatggtcggagtttattgaaattagatgaattcaaccaacaaatggtcttacaccaaatcctagcggaacaattaacggttaaggatacggaagcgctagtcgcttcaattattaacccagaaccagccgttgaagaagaagtggcggacatcgaagaagaaccagcaaccactgaagaagcaacagaaacacctaaaaaggctggtaagaagaaggcgcctaagaaagaaatgacgacagctgacacaaaagtggccgttaacaccatcaaaaaatcaatcgaattgattgaacaaagtgggattccagtttcagcagtcgaagacgatcaaaaagacgtctatcggatcacaatcgaaattcctaagaaatagatggcgcatgttatttcaattgcaaaccaaaaaggcggggttggtaaaacaacaacgaccattaatttagcggtttgtttagcagatgcgggtaaccgagtgttaatcattgattctgatgcacaaggtaacgcaacgagcggtatcgggattcaaaaatcacaagttgaaaaagatatttatgatgttttagtcgatgaaattccaattaaagaagcaattttgaaaacaaatcatcagcacgttgatattgtgccggcgacgattcaattagccggtgcagaaattgaactaacggcccaaatggcccgtgaaatgcgtttaaaacttggtttagaagccgttttaaacgactatgattacgtcttgattgactgtccaccttcattaggacaactatcaatcaacgcctttacagctagcaattcaattttgattccagtccaaagcgaatattatgcgctagaaggcttgagtcaattattaaatacggtccgtttggtgcagaagcattttaatccgaaccttgcaattgaaggggtcttattaacgatgtatgatgcccggacaaacttaggggcccaagtgattgaagaagtgcgcaagtactttggcgatcgcgtttacgatacaattattccacgcaatacacgattagcggaagcacccagtcatggggtttcaatcattgattacgatcctaaatctcgtggggctgaagtttatcaagaattagccaaggaggtgttagcagctaatggtcaataaatggtcaataaaaatggtaaaggactcggtcgagggctcgaagctgttttttcagcatttgagggacccaataagaatcgtgcggatgaactcgttgaagagattgccctcgaggatattcgtcctaatccttatcaaccacgtaaaacgtttgatgaagcggcactagcggaacttgctgcttccattaaaaaatcaggcgttttccaaccgattattgtgcgtaaaagcattaatggttacgaattaatcgctggcgaacgtcgtttccgtgcttctaaattagctggcaaaactacgattccagcgattacccgtcaattcgatgaagaagcgatgatggaaattgcagtcttggaaaatcttcaacgggaagatttaacaccgctagaagaagcgcaagcctacgacacccttttgaagaagttaaacttaacgcaagctgaagtgtcagaacgcttaggcaagagtcgcccttacattgccaattacttacgcctgttgggcttaccagcagacgttaagcaattgttgcaagaaggccaactctcaatgggacaagcacggacgcttttatcattgaagaaaaagagtcaaattagcgccctcgccaagcggacgattgccgaaagtttaacggtgcgccaattagaacaactcgtcaaccaaatgaatcaaaccaaagcggctaaagtcgctaagactaagattaaatcaccttacattcaagcgagtgaaaaccaattagtcgataaatttgataccaaggttaatattgcgatgaatagtaagggccggggtaaaatcgaaattgattacggcacggtagaggatttaaaccgaatcttggctttactagatgtcaatattgattagatgtatgcattaggcgatctcgttcagatgaaaaaacaacatgcctgtggcaccaatcgttttgaagtggtccgcttagggatggatattcgaattaaatgtatgggctgcggacacgcggtcttattaccccgccgggaatttgaaaagaagcaaaagaaagtgttggttgcggctgccgatgttgatacaacaacggaaccacattatcaattgttgtcaaaaggtcccaatcaaactaatttttaaatgtcattaactgcaggaattgttgggttacccaacgtcggaaaatcaactttatttaacgccattactaaggccggagccgaaatggcgaactacccatttgcgactatcgatcctaacgttgggatggttgaagtgcctgacaaacgtttagaccggattcaagaaatcattcccgctaagaagattgtcccaacgacttttgaatttaccgatatcgccgggattgttaagggcgctagcaagggtgaaggtttaggaaataaattcttggaaaacattcgccaagtggacgctatcgtgcatgttgttcgtgcttttgacgatgataatatcacgtctgtaacggggactgttgatccgttagacgatatcgatacaattaacctagaacttagcttagccgacttagaaagcgtcacaaagcgttatgcgcgtgttgaaaagattgcccgcactaaggataaagaagctttggctgaattcgaagttttaaagaaaatcaaacccgttcttgaagaaggtggctcagttcgttcaatcgaatttaacgaagacgaagctaagatggttaaagggttcttcctattaacgtcaaaaccagtcttatacgttgccaacatcgctgaagatgcaatggcagatcctgatagtgttgattacgttaaacaaattcaagattttgcagctaaagaaggcgcagaagtaattgcgatttcagcaagaactgaagaagaaattgcctcattagatgacgctgataaagctgaattcttagaagcagaaggcgttactgaatcaggtttggataaattaatccgtgcttcataccacctattagggcttgcaaccttctttaccgctggtggcaaggaaacccgtgcttggactttccgtcaaggcatgaaagccccacaaactgccggtgtgattcattccgacttcgaacgcggttttatccgggccgaaacagtctcatttgctgaccttgatcaatacggttcaatgcaagctgttaaagaagctggtcgtttacgtcttgaaggtaaagaatacatggttgaagacggcgacattatcgaattcagattcaacgtttaattggctaagacagaaccagcagtagaaacagagcaagtcgatgttgacgcgctcagtaaacaattaagtaagaaaaacgcggactatttatttaaattcaagcgtgctttaaaagaagaagatgtttcagccgaaaaagaagctgaaatgcttgctgagatgttacccgaaatgcttgaagcacaacacaaaggacaacccgcaacgcaaatttacgggccagtcagcacgaagattaatcaattgttacatgcgccaaaagcaccggttaaaacgagtttacaattacaaatgttggataatgctttgattttcttgattatgtatttagctttcaacgggattgcagcgcaattttcaagcaagaattcaaatgcaatgattgggattacctcaattgtgattacagctgcgatggccggcgttatcatgacttatccaatgcgctatacacaaatgcctaaggaacaacgcccaccattctggaagatggcgttaatcgttgtcggtttaaccttggcctttgtcgccgcgtatggtgtgacaatcttaattccaggtttcatgaacccagtcttaccagcatggattcaaatcgtgattgcggcattattaatcgtagtccgcatctatatcaagcgtcgttataagattaccggcactttcttcgggtagatgattagtatcgaagaacgccaatttggcgccgtcagcacgttaattgtgacgccgggtgggcaagaacaaaccttgttaccaacggtatttgtctatcatggttggacgcatcggaaggaatctgaattgatgttggctaactttctcgctaaagcaggttttcgggttgttttaccggatgcaaaatatcatggtaaacgccatggtagccaaatgttttcagaattaatgtttgaattctggcagattgtgatgcaatcagtcgatgaatttggcccattagtcgctgcattacaagcggaaggcttagttgacccagaacggattggtgttactgggacatcaatgggtgggattacaacggatgctattttagctcgttatcccaacgttaaagtcggtgttgataagattggctcaccaatgccggttgcttttgccaaatggcaaaccagtcaattaccacaatcgattcaagaacggtaccaagatcaaattgaaacgacactcgcagatttagcagaatatgatttggcattaaatgctgagcgcttagcgggtcgcccactccatttttatcacgggaccgctgatccaatggtgccctaccaatttactgctgatttcatcacgcagattactgaagatgaaacaccggcaacaagccaagttacattgacgactgaaaataacggtcaacataaagtatctgacgaggcccaactggacaccgtcacatttatgcaggcccatctgaaataaatgacaaaaggaacagttttatttgatttagatggtacgattgccgactcacaaaagggcattatcaatgccttagagtacatgattgaagaattggccttgccaacgcaaacgacggcccaattaattagttttattggcccaccacttaacgaaacaatcatgagagtctttggtttagatgaagcagcgacgcaacaggcgattaaaacattccaagaatattatgcgcctaaaggcttatacgaaaatgaactttatccaggcatgcacgaaacattggcagccttacaagcacaagatttacaattggcgattgcaacgtctaaacctgaaccctttgccaagaagattatcgaccacttagagttaacgccttactttagcggtgtctacggtgcaagtgttgatgaaacaacgcgggttaaaaaagcggacgtcattacttatgcgttggcagaacttggtttatcaacgaagaccgaaccactcttgatggtcggcgatcgtcaaaatgatatccttggtgccaaacaaaatgaaatggcggctgttggtgtcagttatggtttcgggagtatcgccgaactgaaaaaagccggtgcggtccaaattgtgacccaaccgactgatttaattacgacgttacccgctaatttgaagctctaactaagcgtgtttttgcgcattagcgactaataacatgtagattcggccaacatcacgtgagttaccgcggagttcgtaatccgcgatgaaggggacgttaaactgttcggcatagcgtttagcagttaagcaatattgttcgttgaaattacgattgccgctgccaatcacgccgtaacataaatcagcattacgcccataagcgatatattcgcctaagctgttggtcatcaattctttgacgccattatcgataccattgccaccatctaagtatgtgggcacaaaagcgtaaaaaggttctgtttcatccttaaagggggttgcatctgaaatctcagttaatgaaatagtaggcaaagccgggttagtggtatgttgttgttgcgcatagtcttgtaaatcggaaacaaaagaacgggtattaccagctagtgaaatatataaaatggatagattagtgatcatatgacaaatatgagtcgactggatcaaacgccaaagacgacaagaccgaataagggtctcagccgttttctgacttttttaattttttgctgtgccttcttcgggattggcggcatcattttaaatcaaacagtcttaaaagaatcattcacccaagaacaacttaatcagccgaagaccttgaaactcgtgacaaacgaattcaatacagtcttattagatgcggcgcaaaaaaatggcttaccgcaatcggttcaagtccaattgctctcaactgcagacgttaaaacggatatgaacaagaccgttaagaacatctatgcgttcaaagatcggccattagatagtgatcaaatggttgaacaaatggctgggaatttaacagcggcgattcccagcaaccccattgaacaagctttagtcaaaacggctgtggcggctgttcaaccaccattgaagacttatttaaatgatcaaattcaaacgccttatttggcaccaatggtttctgaattggccatcatgacaagtgtcgttaacattgggatgtggattgcgattatcatggggatcgtcttattaatcgtccaatatgcagtcagtgggaagttccgctacctattcgggagtttgggcgcagcacttgcttggagtggcctattcctcctcttagggactgaaacggccaaattcagtggcttgattgaagaagtcgcccaacgtgctggtgagttcaatacagtcattattaactatgcaacaagcgttttggattatgcttggcaaatcagcctgatcacattgatcagcggggttgttttgtggattctagcgaagattttccagaaggttcgttaattaataagctgtgatgacaatttggtggtcgagataattggccatgtagatctgctgtagttcgtacccttgttgggcgatatcagcgagtaaccagtcttcatctttgtcgattaaacttaatgcatcgacgttgatttgcccatccataatcagtgggtatttgattgttgcgtcgcctttttgggtaatcgtcagttggccgttttgttctagaatcgcccgttgaacggtccgaatatcactaatcccagcaattctgagtttaaaagcgagatcttgggctgacaagctatttttggcagctgtttgggcatcgatgtggccattagtgataatcgtttggggaacgccgatcacccaacgtttaattcgttgattatgtgtggttaggaatttcatggtgaagacaattagcgtccagattaagagtacgaggaaaaattggataaacgagatatcggcgttataaatcataccgccgacaattccgccgaggacgtaattttgaagttgatcgatcccactggaaggggctaagttacccttaccagagaggttaatttgtaaaacgaggcagaaaaaaccgagaataagtttaattgtgatatctaaataagatggcatttattgtgagtgcgcagtgttgagctgctccactcttgtatactgaatgccaccgagcaaaacgccgactaagacgaagataatcaagaggtcccgatattttgaatcggaccggtggcgtaggtattggacaaagaaaatgagaattaaactcccaacgagcagtgagagtaatattttgaaatagaactcgaaatcattttgattgatgaaataagaatagcgataaaaaagcatatgaaagggatgattaatatggtattaaaaataacagcagcagctcaagagaagattcaaaaacagatgacgactgatcaagcattattactcgacttaaatgacggtgtcggccccttctcaaaggttggtttttgttcattagatactgattttcgtttattaattgtaccaaatgatgcggatctaaagagctatacagaaacgtttgactcggaaatgggccctattcactataaggcatatacggccgactattttgacggtcacgaggtcctcgatttagatgaaaaacgccaagtattaaccttagttaataacagcggtgtcgttgataaccgggtgccaattatcgtttttgatcatgaaaaaataacagaatagatgaaaacggcaattgtaacagatagcgccgcttaccttgatcctcaggttgcgcaggccaatcaaatcatcgttgtaccgatcacggtgatttttggccaacaaacttatttagaaaatattgaaatttcaaccactgaattttatgaaaaaatgcgtaccaccgataaattaccaactacgtcccaaattacgatgggtcaaatgcagatggtttttgaccaactgatcgaagatggtttcgatgaagtcatttgtattcatttatcgagtgggattacgagttttatcaataacctgcaagcttatgctcgccaagtcgaaggtattagagtttatccatttgattcgaaagtcacgagtgctggcgaagctttcctagcattagaagcagcgcgtctagtggcccaaggcgaacacgctgaaaccattatgcctaaattggctgctttgcgggagacaatcggtgtttacttcgtcgtcgatgatttgagccatctgatgcggactgggcggatttctaacggggccgcctttgtcggcaacttattacggatcaaaccaattttaagtttcgatacagctggcaaaattgttgcgttgaccaaggaacggacgaaaaaacgggcctttcaaaaagtgttaacggattttgaagccgccgtggcagccgctgattatccgattcgcgcgtgcgtgatcgatgggaataacccagaagaaagtgcgcagtgggttgagaccctgacgaccaaattcccagggatgccaattgaaaccagtcatatcggaccagttgttggggttcacactggtgaaaaggtgatgggcattatttggggccgcgattatctaatttaattaaagtgttgtatctgcacgttgtggattgacggaaacttcaaaccaatcaatgtaaccacggttaaattcagcgaccgttaaatcgaagcggtcaattgaaacaacggaatcttgatgtaagttagcgaagttttccaagacataaccggcaacggttacgctatctgatgcttcaaaggcttcaatgtctgccttgaagaagcgttcaaaatcgtaaagcgttgttttaccgctaacgcgataacggttgtcattttctttgatgatatattcatccgaaacgtcatcgatttcatctttgacagtcccgaataattcttcgtaaatatctttatcggtgacaatcccactcgtcccaccgtattcgtcaacaacgaccacaatcggtgtttgtttattaatcatttgcgttaataaactatggatgggtgttgtttcgggaacagagatgattgagcggagtaatttgctaacgcggattgaatcatctacttgtgcttggcgcaccaagtcgtaggcgtagacgtaaccgagaattttatctttatcattttcagcgaccactgggaagcgactaaatccttgttggagataatccttaacaacgtctttgacggtatccgtaatatcgacgacgtataaactagtccgatcgaccatcacgtctttggcaattcgatcgttaaaatcaaaggcccgttgcatgtaaactaaatcgttacgatccaattcaccaccggttacggcatttttagaaaggctgatgatttcagcttgtgataaaacatcgctactttcgtcagcaggtgcaaaaccgatcagtttaacaacgccgtttgcggaaacatttagtaaccagacaaatgggtagaaaatgatgtgacagtaatgaagtggcttagcgacggccatcaacatctgcattgggatatcgatactgatattcttcggtacaatttcagtgaagacaacttctaaataggttaggactaaaacaccggcaactgcgccgataatgtgcaggccgctctcagagacaagatgcgtcaagcctaataaatcaactaacactgtttcgacagttgattcaccaatccaccctaaaataatccccgcaacactgaccccaacttgcgtggttgaaagatactcattgagattttgagtcatcttaagggcgagttttaattttttaggactaccatttccggaatgaatcgcatcttctaaggcacttggacgtgtttgaacgagtgcgaattctgcagcaacgaaaaaagctgctagaaagaaggtaacgagcatgacgaacagattggtaaatatctgaccacttgacaattagaaggttgctgtatcaggatctttggctttaccaacaaccccatcgagttgatcgatagtttgcatatcttcaggtgttaattcgaagtcaaatagttgcgtattttcttgaatgtagttggcgtgaactgattttggtaatggtaagaaaccgtgttgcaatgaccagcgcagtgcaatttgtggaattgagcgttggtacttagcagcgagggtcttcatttctggcacatcaaagattttaccagtgccaagagggctgtaagcttctaataacataccgttatcgcgtgagtattgcaccgtttcagcttccaattcaccaggtgctaagaagatttggttcaccattggttgcaccttagcagtctttttcaaggcttctaagtggtgtgcacggaagttgctgacaccaattgccttggctttgccagcattgtagagttcttccattgctcgccaagtttcagcgttggctgcttcccagttatcacggaaatcaattgggttaggccagtgaatcaataataaatcgacatagtcggtttgcaatttttgaagtgattcttcgaaagattgcattgttaaatcgtagctgtgattagcgttccaaattttagttgttaaaaagagatcctggcgtgccacaccactttcttggatggcagtgccgacgctggcttcgttttggtaagcttgggcagtatcaatgtggcggtaacccgcttcaagtgctgccttaactgatttaatggctgtgtcgccatctggtgtttgccaagtcccaaagccgagcactgggatttgaacgccgtttgctaacgtatatgttgttgttaatgtcgtcatttattgcccgggaaatgttgccgtttgtaacgctaataagcgtttttgtaaagcgggatcgagggcgtagaggtaaaggccgttgcgggcccggctcatcaagacgtagaggctattgaggatgatttgagtcttaatctgggttggattatcaaagcgattggcaccggcaaacgccgcttgatcttcatagtattccggtttgatcagtaagcaatcttgttgtgggtcatagccaattgacgggcctaaaatgacgccggcatagtttaaatcgaaaccttgtattgtataaaccgaaccaacttcatcaatactatcttcacgttccgcccaataagtcttggcggttggttgataccgatcccagcgtaatttgaaatgcggggcacttacgtaatggtcgtgcgggtcattgagtgttgctgggaaatcataggttgccagtaaccgagccaaaccactgtcttgattacgttggcgaatagcggcgtacagttgggctgcgtctgtaaaaattttgaattcaaaatgcggatcttggggcaagacttcgatctgcattttgtgaaaggcttgtaaccaagattcaaccgagggatttgcctgaattcggaattgatggtgtagctgtgctaattgataaggcccggtttggagtttagtgagtagctgttgttgctgccaataacttttgaccttaaggacctgttgttcatcaaaaatgagaatcgtgatgcgactgtgcttgcgaatctcatctaactgattatcctgtctgaagtggttataaggatcgctgtgcgtcaataagaggtgcgcttcatcgactaaaacgatatcggcgcgggtctcttgtttgctggcctggttgataaaagttgtcgggcgttgaaagtcttttttcaagagcgcgttagttggttgaacgttattttggtagagtttcaacatttctggatgattaaccagtaatttgttgttagtttggtacagcggtgaagtcggcgttttacgtgcaagttcttggagcgtcgagaagacgctgtttaaaatcacactcttaccggttccggcggcaccttgaattaagaaggtggcgtggtccgcatcacgattttgttcgcaaaattggataatcgcggttttgagttgctgttgctcggtagtaagttgattagccgggcgtgtcaatttgtagagggcgctgttttggtgctgagcattaggcaattaatcgacaaagactaattggaattcgtgttttgctaggtcgatattgactgagacgtggcggtttaagtcggccacaattttgtgtgcaagggtgacgcgttcttcgaagctctgtgcataggcttcaaaaacggtacctttaaaattaaagttttcagtgataaaaatggcatcggtcacaaatagcagattattttcatcgtggcgtgaaccagcttttaaggttgtgtcgatgtaatgatacaagtcggttggatcgaagtttaacggtttttccaagattggtttgatttgaaagccagctaaatcgtcaaccatctgcgcattgagcgtcacttgtgttagagcttgatataatttcatttagcgtgttgctttaggccggtagagcacaaaatgaacgagcaaggcggcgatttggcagccaagtgctagataacaaacagctgcccaaccaccgagactccaagcaagagcgccgaaaaatgagccggaagccccaccaatgaagtaggcaaacatgaagaccgtgttattacgactgctggtagcttcgcctaaggcttggacccgcgtttggttggacacctgaccacactgattaccaacatctaataaaacgattccgagcatcataactggcaaatactgtccccagaaaaggaataagaggtaactgacagtcatcatcaagagaccaactgcgatgataaaccgcggtgtcttttgatcggcaaagcggccaatcacaggggccgcaagcgcaccggctgcaccgagaatggctaataaaccaacggtgccactgccaagatgataggcaggacttgccatgtaaaagacgagagttgaccaaaagatgctgagggtcccaaacatgaagaagccgttaatggccgcttcgcgtaaaagtggttgggtgcgcactaaaccaggtaaggaactgatggtttgccaataactaggcccgtttttgggacgcgaatctttaggtaatttgatggccgctaagataatcagacagccaatcgcaatgacggctaaaaggtaaacccagcgccaattgacgtagctactgataatgccactaaaactccgagaaagtaaaacccccattaagaggccacttaaaatcgtcccgagcacggccccacgtttttggggtgccgctaaaacggctgcatatggaatgataatttgtgggacgactgaggttaagccaatcagtaagccggaaagtgcgaataagatgaagttcggcgctaaaaatgcgactaacaaagagagtagcgataaaatcagcatccgaatgattaaatggtaacgactcatgacatcgccaaaagggacgattaataataagccgagggcataaccgacttgagttaacatcgcgaccgtgccaatggcgccagtgttaacgtggaaggtttgggccaccagggattgaatcggttgaatataatatagattagaaaccgcaacccccgtgataaaagccattaaaagaatcaatggttgtgtgagttgcgtctgttgttgcttattttgcatctacctctcttcaaaacgttcattgagaattaataatgctttgtgaaactcgacttgggcttcaggttcttcttctttatcagcggattgttgcaagaagtctaacatctcaggcgtgacatctctgaccaattggcctagtgcccacgccgcagtcccgcgaataacgggtcggggatcgttatcgattaattgcaataactggggaatcgcagttcgatctttgacgttggcaagcgcgataatggcgttgcgctggattggtttcttccctcgccacgaaccagataagtgaccgaatttaactttgaattctttattgctgattgttagcaatggttgtaattctggcatcactacttctggatcgggttccatgtcaggatggaagtggaagtccttgcctttattaaagggacaaacttgttggcaaatatcgcagccataaatcacgctccggattttagggcgaaattcttctggcataaagccttttgtttgcgtttgataagaaaggcaccgtgtcgcatttaaccgaccgtcacctaatagggcgctaggtggacaataatcgatacagcgggtacagctgccacattggttggccataggggtatcaggttcaaacggaatgttggtaatgatttcgccgagatagacgaaagacccgaattcaggggtaatcaataatccgttgaggccgataaaaccaaggccggcgcgttgtgcaacggcgacgtcacttaattcgcctgtatcaaccattggtttgaaagtgacttcatcatcctcatcggcaagttctttgatcgcgtcgatcaattgggccatcttgtcccgtaagatatcgtggtaatcaatgccccaagaagcccgtgcaaaactaccgcgtttggcacctgttctggcgggtttgttgtgaattttggttgggtaagcaagcgcgatagcgataattgatttgggttggtcaaaaatcaattcgggatagaggcgttcttccagcaccttgtgttcaaaaccgctagaatgaccgtttttcttttgttcgattaagctggcctctaaatagtcaaaaggcgccgctgaggtaaagccaattttatcgatgccaatttctcgactggccgcgatgacttgttcttttaaagttggcatttacattaagtaaattttttgtaagtcagttaaatcatgattggttagttgtaattcagtcttgaggtaattttgaattgtgccggattcttggcgaatcgccatttgtgcggtttgaagataatccaagtgaacggtcaataaggattgaacgctttggtaaatgccttgatcggccgtcttttgttggaggcgctgtaaggacttctgcacaaaatcagccgatgcgaggttagtgagcaggtaatcagcttggatcgtctctgcgggcacattaagggcactgagtaagaagacagcggccatgccggtccgatctttgccagccgtacagtggaaaagagttgtttgatgatcttgatcgttggcgagcagtaattcaaaaaagcggcggtaagcttgcttagaatggggctgattaatcaaattgtcataaaccttttgcatccgggtgtggccgctgagtgggtccttgctaaagagttgatagagttcatcctgactcgctgaattggctgtttcatcaacggcaaaaacagggaggaattcgtaagttgcattagcgggtagtcgatcgggcgctttggctttttcatcttcagaacgcaagtcaatatcatagcgcaaaccgtattgatcaagatagtttaaatccgcatcagtgaggtgggctaagttggctgagcgcagtaatttatgccatttaagcgtgcggccatcagtcgtttgatagccacctaattctctaaagttatggcctttttcgagtggtaaaatccgttgtgtcatatgattacctatttcgaaatacagacgaccggtgagattcacgaaaaccgctcggaaaaagcagccaattggattcactttgaagatcctagcaagcatgaaatgcagcattttgcgcggaagtaccatttgccgcgcatgttgtttgaggtcgcccaagatatcaatgaagtggcccggtatgaaacgtttacgacggaaacgggtgaaatacttagtcatatctgtctgttagtgccggtcaaaacccatgattctgaaaaacatgctgaatacattacgcggccgttttcatttatcatcagtgggcaaaccttactgacagttggacaccaacaaagtgaattggtggccgagatgcaacggattacgggaactgatcaacaggtcgaaagcattgtgttacagagtatctcgttgatttaccaacgttatttgaccgccttagatgtggtcgcccaacagattcatcagttggagaaaaacgtccatatttcgacgcggaatcaaattttatacgcactcaaagcacttaaaaagagtgtcgtttacttggatttgggtttaaaaagtaatcagcagagcttaccgcagattaaagaggcggcgttatttgaagaagtggctgatcaaaaagatcgtctttaccgcatcgatttacagtttgctaaatcagataaggcgattacgacttatcgcgctttgttagaacaattaagtgatttattatcagatatcatttccaatcgtttgaataacatcatgaagacgttgacgtcgatttcgattgttttaacggtcccgaccattattggtggtttctgggggatgaatgtgccagtgccgctaacgcatagtggtaaggggtttatcctgctattgggcttatcgggaattgtgagtgccttggttggctggtggctgaagaagaaggattatttttaaatggttcaagaatataagagaatattagtaccagttgatggttccgaagaagctgaattagcccttaataaggcagttcaagtggctaagatgaatcacgctcaagtagatattttaaatgtattagatacgaaacaatatgcagggagttatagcggcatgctttctggagatgctattttccaaatctcagaagacgcacaaaattatctcaatagtttgaaatatgatattcaaaccaatgataatttgatggacgttgaaattcacgtccgttttggcaatccgaagaatgtcatcgcacgtgatttcccatcagaatacaaaacagatttaattatgatgggttcaaccggtttgaacgctgttgaacggatgttaatgggttctgtcacagaatacgttaaccggacagcgatttgtgacgtgttgattgtgaagactgacgtcaataacaatccctacaaaaaataaatggcaagcgataattggatgaatgcgacagcagagctgttaacttactacgaacaagaatggggccaaccggaacacgatgaccagcgcttatttgaattgttgtgtttggaaacctaccaagcgggtttgagttggcaaacggtgctggcaaaacgggcggcttttagaactgctttttaccagtttgagattcaaaaagtcgcgcaaatgacgacgactgatattgaccgtttattacaaaatccagcgatcattcgcaaccggcgtaagctagcagcaacggtgaataatgcgcaagttgttttagcaattcaacaagaacaggaaagttttgcgcactatctgtgggcttttgttgacgggcaaccaatcgttaatcgaccaaaaacgtgggcagacgtccctgcacaatcagcattatcggttgcagtgagccgggatatgaagcgtcggggcttccaattcgttggtccagtgacggtttattcttacttgcaaggtgcgggtttaattgacgatcatccccagcatctgaagggatagatggcacaagataacgttcgccaattagcggattggttagaagaaaacatgacggcaattattgatcgtaaagttagcctcaatgtttcagaaatttttgcagtattagatggttttggtgttttgaataatccagtagcaaaatacttggatattacagaagaaacttactatcaatccgaatcagaccataaattaaccttatcagatgaccgtaaattattgatggatgttactgaccggatcatggtaacccacgttgatggcattttagccgataacaaagttaactttgaatacagtcacgaagctgtttatgaagatcaatacttagtgaaacgcgacttagaagtcctcacttacggcttagccgtgattggcgctgttgcggccactgttaaacataacctcattcaagcggacctttctaaggatgctgtcttgagtttggcacttgctgctcaaaatattgcgaactggcaagtaaatcaatagatgacaaaaattgcaattgccggttctggtgcaatgggcagccgttttggctacatgctacaagcagccgggaacgatgtcgtcttactagacaactgggtcgaacatgttcaggcaattaataccaagggtttaacggtggcgattgcggggcaagacgtgcaacacgttcagattccagcagccttacccacagcgattaaagacgttcaagatgtgattatcatcttcacgaaatcgatgcaactaggggcgatgctccaatcgattaaaccgctgattggtgagaagacgaaggtcgtttgtttattaaatggcttgggtcatcccgaaacaatcgaacgctacttacccaaacataatattttcgtcggcattacgttgtggactgctggtttaaccggtcccggtgaaattagccttagtggttccggcagtgttgaacttcaaaacgtggcgccagaagctaaaggtgctgctgaagaattagtcgcgatgttgagtgctgcaggattacatgcgacctatagtgctgatgtcttgttttcaatttggcgcaaagcttgtgtgaatggcaccttgaatagcctctgtgctttattggattgtaacattgcccaactcggtcggacgagtcaggtcaactcattactggcttcgattgtggctgaattttcagcagtggcagcgaccgaagcggttgatttggatgtgccaacaacgattgcgcatatcgatcaattatttgatcccacccaagctggtgaacattatccatcaatgcaccaagatttaatccaacaccatcgtttaactgaaattgactacttaaacggctacgttgcgcgcaagggccaagaacgtggcatcccaacgccggtcaaccaattgattacccaacttgtgcatactaaagaagcactcgtcatcgaaaaataaatgacagaaaaacaacctttaaacattgaagtcacttcaatgcactaccaaaaactattaatcgcaattgatgatgatgatccaacgtcatcaaaacgcgcttttaattacgcttgtaccgtcgctaagatgtaccaaattccaatggggattgtcagcatcttagaaaccggcgatttaaatatctatcaatcactctcaccaaacgtggtcgctaaacgacgggaagaaattgccgcagacctagacatcttcgttcaaaaggcgcaagaatttggggtgcaagaagtgacaccaattcttggtgaaggcaatccaggccacgtgattgttgaagaaatcattcctgaattcaaaccagatcttgtcatctgtggttcgaaaacaaaaccttcaaaacacttaatcggtacacatgcgagctacttatctaaatatgcccctagctcagtaatggttgtccgttaaatgctagaatgtccacaatgtcatattaaatatggtcgcaagctgcagcagtgtccaaattgcggtgcggctgcaatcaatcacgaaacgactcaagccaaaccaaccgcactcaagtatcaccaatttttacaggcgagttggcggcaacccctacaaacaccatggcagtgggttaatccccaatttggctgggtaacttttgccatcttattgctggttaatacggcgacgattagtttattgatggcgggctggtccgaacaagtcggggccgtggccggtgtcactggcacgcaagttatcttacgccagccagtggctttatggccgcttgaattacgcctctttttaatccaactgggtggcttattagttctggtgggaaccgggtacttactgaaacggtatcttttaaaacaaaaaaatttgcgttttgaccgctatttaactgaaatcagtgcttacgggagcttcgtcttattgctaacgatggcggccttgttggttacttttatggctggcttgatggcgctgtggttagttgtcatcttactggtgttgagttatctctgggtgaatatggcaattgtcgtcagtctaatccgtcaaccaatggcgggcttcgatcaattttacacggtcatcctatttgaaattattgttcacttgctattgcttgtgatgagcagtcaggtcgttatgatgggccttgcgaacctcttttaaatggcagtaggtacagcaacattggttttagatatgaagatgtcagaggcatttgactggagcgacgatgcaacaatcgtgagagaagcattatgggaccactacatggaatcaaatggtcacaatacggatcaaacagttgccgcaatgaaaccttacctcagcatgagcgattcagaagtacggactaaagctgaagcacttttaaaaaaataattagacgttatacatataagcacgtgtcattggtaaatcacgggcgctagcgcctttagaaacgaggtattgaataacatcgatattaccagattcaaaagatgaggcacaagcttggagatagagatcccacattctcacgaattcaagactcgtttgttgttggatttcatcacggtgtgcgttgaaattggcatcccaaatttccaacgtcttttgatagtgccgacgtaaaggttccatatcagcgatttgtaaaccggcatcgacaatgtgttgcgtattttcaaccaagcctggcacatagccacctgggaagatatacttgttgatccaggcgttcttggcgccgccttgttgacgcgtaatgccgtgaataagggccacgccatcgtctgttaagtaatccgcaacatctttgaagtattcagccaagttttcttgaccaacatgttcgaacatgccgacacttgtaatgtaatcaaatggggcgtgttttaattcacgataatcgacaagttcaacggacgcaacgtcactgaggccttcttcgtcaattcgttgttgaacaaaattatattgttcttggcttaaagtaatgccgacaacttttaagtgatattccttagcggcggttaacatcaatgtgccccagccacagccgatatcgagcaatgtccgattaggttgtggattgagtttttgtagaatatggtgcactttgttgatttgagcagtttctaaatcatctgttggttgttcgaaataagcacaagaataagtcatggttttatctagccaaagttggtagaaatcatttcctaagtcgtagtgactttggatatcctttttgctagctttttctgaatgtgattgtttaggtaaaaagtgaatgtaactgtgactgcgcataaaactctctgagctgttataagcggctgtcagtagtttttgaagtggtgcgtcacctttgcctgtcacctcaatatcgcctgccatataggcttcccctaaggctaatgaggcgttgctggttagtgatttgatggggatgagttttttaaaagtaattgctatttcaggctctccggttccgtagacgtcagtactaccatcccaaaagtggacggcgactggaaaatcaaaagagtgttgtagtagtttcttataaaaagttttttctaacatgtgactttataccaacgatttgtagcgaacgaacaattacggcgcctagtagttctaatggggatgattggtgttatttttgcggttcgttcaatgatgaatatcatcttgttgacgttcatctttacttttttagttacccaattggtgcgccacgtgcagcgttatgttcggataccaccagccgcggtggttgtaccactctacattttagtgattttattggtctatctcggggtaaccatttatgtgccacaaatcgctaaacaaacgattaaattaggtgaaagtgtttataatttttaccagagtccatcctttgatgccaataaattcatgcaactgatcagccaatacatgaaacagtttaatttgaccgaccagttaaagcatggtgtttcaaccttggttaactatattaccgggattggtacgatgggcgtgacgattgtcttgtcgtttatcctcagtttcttttatacgattgaactggataagttaccacaatttggtgggctcttcttaaagagtacctacggttggcttttccaagatattgcttactttgctaaaaaattcgtgaacacttttggtgttgtgattgaagcgcaaatctttatcgcggtcgttaatacggtcctcacaacgatcacattgacggtgatgaagatgcctaatattccgagtttggcaattatgattttcttattatcaatggtcccagtggcgggtgtgattctgtcatgtattccactatgtatcatcgctttttcagtgggtggtgtgcagtatgtgatttatattctggtgatgattaccgtcattcacgcgctagaagcttatgtcttgaatccgcgctttatgtcgagcaagacacaactaccaatttttttcacttttgtcgttctctttgtcgctgaacgtttcttaggcacgtggggcttgattgttgggttaccaattttcacgttcttcttggacgtcttaggggttaaaacaattaaaacgaaataattatgaaagagattcggggcgggttaagttactgtcggcaatgatgacagcgagttgattgagatcaacttgtaattcagtcgcgatgatgaacaacgcttttaatgaaggggcagcgcctttttcccagcggaaaatcatggagctactgaccttaatattgtatttttgcgttaataaatcggctagctgccgcatcgtaagattccgtgaaacccgcttatcatgtaatagttgtccaaacatgtgctatcaggatatttaaagggtcgtgacatcaagcagcaggaagttgctgatgttttaaataaaacgctaacaactgctaaccgtaagattcgcggtaaaattccgtttaccgtcaaggaaattcagttgctacacgatcagctagatgtgccgattctaatcttctttgaatcttagttatttttcattaagtaaagctaatttaccattcacaatcatttcgcataaatcagggtagctaataccaagaacttctgcttcttgaggaattaatgataatggtgtcataccaggtaatgtattgccttcgatgacgtataagccagtttcaggactccagaagaaatcgatgcgggcgtagttggttaaaccaagcgcgtgcatggcatcaagcgccatttgtttcatggcttcgtgaacattatctggtaagttgttaggtggtgtgacgaatttcgtcgtgttacctgttacgaatttgtgttcaaagtcataccaaccgtcattgacttcaatttcaatggctggtaatggttgttcgttaatgacacccagtgagaattcgcgacccttgatgaattcttcgatcaaggcttcgttatcaaaacgcaaagcatcttcgacagctggttttaattcagcttcgttgtggacgatatgtgtcccaacacttgaaccaccattacttggtttaaccacaacagggtattcaaatggcatttctggcattggttgatgacgataagcagcgacaaaacgtgctgttggaatgttgttgaagagtaagatttctttagaaacttttttgctcattgtaataccagcagctaatgtgtcactaccagtataaggaatttcaaagacatcgagaaccgcttgaactttaccgttttcgccatcgccaccatggagtgcgaggaatacgatatcagcagttttacaaatttctaagacattcggaccaaatagttgtgttgaaccatcttcgcgaagtttattgatgtcgtcatctgttaaaacttcatcatcaatatcataatctttttcaacgggatcagatgaataaagagagtcgattgtggcaccatctttcaattcattccctaaaaaaagatcgacaaaggcaacatcatggccttttgtttgtaatgcatgggtaatcttgtgtccggacgttagtgaaacgttacgttcagtactacgaccgcccgctaagacaacaattttcatatggcaaacgaattaatggatcgtcgtcaagattggttagatagtttagtaggtgatgactttttcaagaacttcggcaaacaattctttgcaatgtcgcctgaaactgacaacttgttgaaaacagacgtgaaggagaccgataaggattatcaattaacggttgatttacctgggctcaacaagcaagacatccacgtcgattatcaaaacaatacgttaaagattagtgcaaaacgggatagttttaacgatcacagcgactcagaaggaaacttgattcaaagtgaacgtcactatggccgcttcagtcgtcaatattatttaccagaagttgatcgccaaggaattagcgcgaaatatgaggatggcgttttgcaattagtcttaccaaaaatggctgaagatacacaatcaacaagccaaattgaaattcaataaatgttaacgttaacgcatcttgaaaaaagttttggggcgatgaaagctgtagatgatgtatcgtttaccgttcaaccaggcgaaatattagggcttattgggcaaaacggtgctggtaagacgacaacttttagaatgatattgaattttttaacaccggatagcgggacgattttgtggcaagggcatgcatttaccagtcgtgactacgatcaattaggttacctgccagaagaacggggcctctatcctaagatgaccgttgaacaacaaattttatattttgcgcagttacgcgggcggaccgcggcggaaattaaaccacaaattgacgagtggttagcgcgttttgctgttaagggccaacgtactgataaggttaaggatttatccaagggcaatcaacaaaaggtgcaactgattgcgaccttaattcataaaccagcgctcattattttagatgaaccattcagtgggttggatcctgtaaatgctggtttattagaagatggtattttatggttgaagtcgcaaggctcggcaattattttttcgagtcatgatatgacgaatgttgccaagattagtgaccggattgtcatgttgcgcaatgggcaaatcgtgttatccggaagtgtcgatgaagtacgagcccagtttggccgcatgaaactcttcttggaatcaccgttaacgcaatctgaactggaacaaattgaaggtgtttcacgtgtaacacgccacggtcaccagtttgaattgacgctagctgacgaagcggttggcaaagagattttcgaacgcgcgacgcaagcaggttatattccagaatttagtcaacaagcgcctagtctagacgaaatatttagattgaaagtgggtgagcaacatgactaaatgactaaatttaagattatttttaaacaggttttctttaaaaatattaaaagtccggcctatatcattatgattatcatgccaattattctattaggggtcgtcctagggatcggtaaattgatggatcaatccaccgaaccagctaagattgcggttctcagtcaataaatgagagggcaagattacgtcattgatacgcaaattaagacgcaaccgcaagcagctcaagcgttgaaacaagaaaaaattgatggttatttaatcattcagcaaggcaatagccaatattttgaacggaaagatagtcgtgattttgatccgagtggcattcaaaatcagttgaatgaaatgaatattgtgacccttgcgcggcaagccaacgtcccagcggaccaaattcaaaaattaacgacaccgatgacggttaaatccgtgaccgttcagtttgaagctgggcaacaaaaaattgatcaatctaatcaaaaacaagtgggagaaggcatttcattagcgattacagtcttaatgtttgtcttcatcgttaattacgcggggattatcgcacaggaaattgcgactgaaaaaggctcgcgtattatggaaatcattctctcaagtgtctcggcgacaactcaattctttgctaaaattgccgctgtattagcattagttttaacccagattgtcttttacatcctaattggtgtggtgggttatcactacttaaaacaacaattaccattatcggcgattttaaagcaagtcggaccgaacctctggacaccaccggtttggtatgcgattagtttcctaattgtcggcgttttactctacacagtgattgcagcaatgctagggtctgtcgtttcgcgaatggatcaggtgcaacaagccatttcaccgttattaatcctcagtacaatcagttatatgtgcgggtttatcttaacgacgcgttcggatatcggctttttaaaaatcctgagttacgtaccgctcttttcacaaatcatgttaccggtgcgttttgctagtggtgacttaactgcaacagcagccacgcttggtcttggcttagcgattatcacgttgataggccttacctatttggcactgattatctatcggatgaacattttggtctattcagacaagggcgtgatgcgctcatttatgcggtcatttgcaatgctgaaagcggaaagacaaaaataaatgacaaacgttcgaatgcaagatgatttttacacggcagtgaatcaagaatggttaaaaacagccgaaattccagctgataaaccagcaaccggtggctttgtggccctggtagatgaaatcgatcaacaattaatgaccgattttaagcaacttaaacaaacggataatgcgttattacaacactttttagattattatgccctagcggccgactttaaaacacgtgatgaactcgggattaatccgattttaccgttcattgcacgggtccgctcaattaacaatttaacagaatacaatcaaggcttggcagactgggtattatcaggcctaccaacaccttttggcttgtcagtagatgccgatatgaaagatacggcacaccacgcgctctacgctgaagcggggagtctaattttacctgataaaacgtactacgaggatggtaaccaaagcgctgaacaattattagcagtctttaccgacatgatggtccaactgttgcaaaaggtgggcttcgcaccggttgtcgcgactaagaccgttaaagacgcgttggcttttgatcgctcactcgcaccatttgtgaagagcgccgaagaagctgcggattatgcaaagttgtataatcctaaaccactaagcgactttatcgcacaacaacaaacgattgattttcaaaagctcttcagccgcattttaccagtgcaaccagataaaattatcgtgactgaaccagcttattttgaacaactcaacgagttggttaatgatgatcattttgaccaatttaaggcttggttacttgtgatgactattcgtgattggagtggctacttgaacgaagaaatgcgccagattagttcaatttatagtcgcgcattatccggtagcaaggaagcaaaaccgcaacaaaagagtgcctattacttagccctcggcatgtttaatcaagtcgttggggattactatggccgccgttacttcggggcaactgccaaggcggatgtcgaagccatggtgaaaaagatgattggtgtctatcaaaaccgcctcgaacaaaatgattggctgaccgcagaaacccgcgaaaaagcgattgtgaagcttaatcatttagggattcatgttggctatcctgaaaagattgcacccatctttgaaaaattggtgactgtatcccaagctgatgatggcacgttatttgaaaatacggctgatttcattcggacgattgaaacggaaaactttgctaaattaacccaaccagtcgatcgtgcaaaatgggaaatgggcgcggcgacagtcaacgcctactattcaccttctaaaaacgtgattgtgttcccggcagctattttacaagccccattttatagtttgcaacaaagcagtagtgctaattatggtgggattggagcggttattgcccacgaaatttcacatgcttttgataacaatggtgcacagttcgatgaattcgggaacttgcataattggtggcaagcaactgacttagatcatttcaagacgctatcacaagcaatgattaccgaatttgatggcttagcatttgctgatcaaaaggtgaatggcaagctaactgtttcggaaaacattgctgatgctggtggcttaagctgtgcgctagaagcggctaaaggtgaagatgatgttgatttggaagccttcttcgttaactgggcaacaatttggcggatgaaagccacacaacaatatcaacaattactattaaatatcgatgtccacgcaccaaatgcctttcgggcgaacgtccaagttcaaaatctagcggatttctacactacttttgatgttcaatcagcagacaagatgtatttagcaccggataaacgcgtcacaatttggtaaatgacagaaaaagaacgaatggttaacggtcagatttaccgtgcaaatgatgcggaactacgggcagatatgaaacgggcccgtgttttaacgcgtctttttaaccaaactacggaagaacaacaggcttaccgccgcgaattgacgcaccaattattcgctcaaagtggcgccgatttatatattgaaccaccgtttcgcacggattatgggtgtcagacgacaatcggtcagcgcgtttatatgaactatgattgtattattattgatgtcgcgccagtcacaatcggtgataatgttttctttggtccccgagttggtctatacaccgccgggcacccaatctcagcacagggccgtcgtgatgacttagaatatggcaaaccaatcacaattggcaacgatgtctggctgggcggcaatacggtcgttaatccgggtgtgacaattggcaacaatgtcgtgattggttccggctcagtggtcacgaaagatattccggataatgttatcgcagtcgggaatccctgccgtgtattacgaccaattgatcaagccgaagaggattattgggcccgcgaaaaagaacagtattttgcagaaatcgctaatgactagctaatgactagttttccgatgacctacaacttgagcgatacagaataaaattaaccagaggcagatcatcaaaaagatggttgttcccagtgggaaatcaaagcgctgcaagccataataagcaattgctcctaaaagccaaccactaaagttgacggcgattggcaatcgacggtagaagtaattgaagaagacaatcgtgtagagtggtgtgaaggctgcgctaatgagtgtgagaaagagttcatatttgaagagttgttgattagcgattaagcccaacccaatcaatgtgacgacgatccctaagccattttctgaataacggattttagggaacaggtttttgagattaacgccagcagaataggcatccaaaaaggtcgtcgtaatggtcgagaagatgatgataaataaaattaaaaagccaaagcgactagttgctagaaactgattaaaatcagtatagccagtcgtaataacggttaaaaagcctaagaaaaacatcattagactaccaagaaagtagccgctagtactccataaagagagtgctagtggcttttttgaatccttggtataatccgcaattaatggtaaccaagaaagggccatcgcaatactgagctcgatggcggccccaaagctcagtggattggcactcagatgagtggcgtgaccagcaaattgactgagttgccaaaaaaggcccaggcaagcaaccactaagagtaatacgatggagttatttagcttgaaaaagaattgcgttttaattgccaaccagaaaataattaagccagccacgataatggcattcatcagataactgaggtgagtcagcttgagttgctgcatggcttgggcggcattagcaatcatgatgccagtccacccaattaattgaatgacgtttaaaatcgcaaagaggataaaaccgattttaccgtaaattggggctgttaactcaatcgcgttttgatgacgcgtgccaccgagaaaactagccggtaatagcaataaaaaggcaccaatcaggtgaccaatgataatggctagactgcctttgacgagaccaaggggcgcaatgagtgtcccagtgatgatttccgcaattgaaatagccgccccaaaccagagtaggaattgattatgattaactttcatttaactttcatgattattcccttctgagctctgccaaggttggtttaatagttggattgcttggggaatatttttagcctgtgtaatagcagaaatcacggccgcccccgcaacaccggtctcagcaacttgttggcagttttttaaactaatgcccccaattgcaacaaccggtaactggctgagttgcgtgaatgtttttagttgtgctaaaccgagtggtgttttggcatcttccttagaattcgtcggaaagatggggcccacaccaatataatcgagcgccggttgttgatgactgcttaggatttcttgagcagtatgacaggatagcccggtaattaggccgtgttgtttggcgacttcaattttaggccatggttgatcagattgcccaacatggagtccgtctgcttgcaaatctaaagctaattctaagcgatcatcgataataaaaggcacgtgataagtacgacaaagtgcttgcgcctttttggcgtagtcggaccgcattgcgtcagttggtaagctatttgggcccttatctctgaattgaaagcaagtaatcccagcttgtaaagcctggtcaagtataggtaaaaagttttctcgaccagtatcttgtgtaccagccactaaataagtttggagtatttcctgggcaatattagtcatttagtcatgttcaacctcctgataagcccaatgatttgtagggccgtgaccgtggccgaccgcaattgggttagcaatggcagcttgaatgaaggctttactaatctgaatggcttttttgagtgggacttttttagcaagttcggcggttaaacaagccgagaaggtgtcaccagtgccgtgggtgcgaacggtcgcaatccgtggtgtatttaaccagtcgtcactaccatctgcgtagagaacgtaatcacaggcttggtcactattatcgagatggccacctttaatgatgatatttttagcgcccattttttgtagttgcgttgcggcggttttaaaatcggcagttgtttgaattttttgaccagttaaaacttctgcttctggtaggttaggtgttaagacagttgccaaaggtaagagttctgatcgtaaggtgtcaatggcggagtcagctagtagagaggcaccaccttttgcaatcataaccggatcgagtgttaaggggccaaagtcgaagcgccggaggttttgggcaacgacggcgacgtgctcagcatcggcgagcatgcctgttttacaggctcggatcttaaaatcggctgcgagcgattcaaactgtttggtgactagttcgagcggtagcgggaagctatcttgaacgccaattgtattttgggccgtaattgcgacgaccacgttggtggcaaagacgtcgcgttcttggatggttttaatgtcggcttgcataccagcaccgccaccactatctgaaccggcaattgttaaggcttgtgggaaattattcatttattcatgagttaagacctccgtgacttgtgcatgggtttgaacgtcagctgctgtgatgttaaacaagcagtctaatagttgtgggtaaaaagaaccaggtaaaggcgttggcattgcttcggcgactaattgaccggcgactgcaaaggtcgttgccgcgtcgatggccgcttgatagggattgtcaggactaacggcgacaaatgcagcgcaaagaccagttagcatatcgccagagccgacgtggacttggaaaagtggcgtgccattggcgactttggtcgtgtgttgaccatcagtgatgatatcggttggacctgaaagtaaaatggttgtttgctgttttttagccgctgttcgagcaacttttacgagatcaatttcgccattgcctgcatcaataccattagcttgccagtctaaaccagctagataagcaatttcgcccgcatttccgcggataatttggggtgttcccaatgctaagagttcatcgataattttctgacgataatgaattgaaccgactgcgaccggatcgatgacgactggtttagcttggcgataagcttcagccattaaagtcttcatttggtgaatgggttcagcggatagtgtcccaatattgatgctgagtgcctgcgcaatagcgaccatttctggggcctcttcaggatcactagacatgattggagatgcaccgattatattttgaacgttggcgacttgatcgaccgtgacgctgttggcaacgttggtgataatcgggttagcttgttttatctggtctaacagtgtctttgacatatgaagaattacttacaacgaatgggtcgttcattaatgttgcctgttgccgtattaccagcagccgcaattttgatggggattgctaactgggttggcaatggcgattcaaatgcaaacgtctttacaattttcctagcagctggtggcggcgcaattttaaacaacttgccattattatttgccgttggtctagccctagggatgtctaaggatcaggatggggcagccgcacttgctggtttagtcgctttcttagtccctaagacaattttagcacctgcctcaattcaagcgatgcaaggtttatcagatatcgctaaggtgaatccagcctttggtaaaatcgaaggtaatgttttaatcgggattatcgccggtttaattgcagctgcaatgtacaatcgtttccacaacgtgaagttgccaatggcgctttccttctttagtgggaaacgtttggtgccaattatggccgcaacagcaatgatggttgtttcagcaatcttgtactttgtttggccagctgtctttactgttttagtatcatttggtgaagcaatttcaaaacttggctgggttggtgccggtctatacggtttcttcaaccgtttattgattccaactggtttacatcacgccttgaactcagtgttctggtttgatgttgctaacattaacgatatcggtaacttcttgggcggtgcgaaatcacttgttaacggaacagccgtgattggtaagacagggatgtaccaagctggtttcttcccagtcatgatgtttgggttacccgctggggcctacgcaatttacaagaacgctcgcccagaacgtcgtaaagcaacagcttcattgatgttagctgctggttttgcgtcattctttacaggtgtgacagaaccacttgaattctcattcatgtttgtcgcatggccactttatgtcttgcatgcagctttcacagggatttcattagccgtcgctgctttcttccactggacagccggtttcgcatttagtgctggtttagtcgattatgttttaagtttaaaaaatccagttgccaaccaaccattgatgttattggttgaaggcttagtcatggcagttatttactacttcggtttcaactttgccatcaagaaattcaacttgatgacaccgggtcgcgaagcagatgatgctgttgatgaagatactgccggtgtcgaaacagatgctactgatgataaattcatgattcaagcaaaacggatctacgctgcaatcggtggtaaagacaatattaaagtaatcgataactgtacgacccgtttgcgtctacaattagaagatacagccaacgttaaccaacctgctatcaaggcagctggtgccgctgggattaacgtcttagacaaaaccaatattcaaattattatcgggacagaagttcaatttgtggcggatgccttgaaagaactttataaccacaacacaccaatcgcaaccagcgcatcagaaccagctgctgcaccagttgaagcccctgttgatagtgatattaactcaggtgagacagatgtcttttacgcagttgcaaacggtgaattgattgatattgaaaatgttgatgatccaacttttgcacaaaagatgttaggtgacggctacgcagtcgtgccaactgatggtaagattgtcgcaccagttgatgggacaatcatgacgattttcccaacgaagcatgcgattggtattaagacgactaatggtttggaagtcttagtccacatggggattgatacggttgaattgaacggtgcaccttttgaagtcgctgttgaagaaggccaaacaatcaagcatggtgacttactggcaaccgttgatcttgatcaaatcgttgcagctggtaagcaaacagcgatgatggtgattattacgaacatgccagcagttgcttacatgaagttcaataatatgggccaatcagtccaagctgatacagttgccgtaaaagcaaccactaaataattatccaaataggtttttaaagaagttgccaatactatcgaataatttttgaatgaagttacggttactttcagtgtttaatttgtcgaagacattcttagcattactttgaatgttatccattaatttaccggcttggttcttaaaatcatctgatttaagcgcaccagaatcttgaattttaacgagtaagttaatgatttgtgtcttttggttattattgatgattgttgtgaggttattttgttctaattgattattaacgatgttggtaatttggttaacggttaggttatcacccttgttagccatgtcttttttagcacctgttacggcgttgttaagttgtgaatcagtatagccgtcagtgcctttgttagcctgggtaatatcactgagggtgctcatttcgtcttgagcggcggtgacttgtgattgatttaaggtttcaccattttccgcgaaagcggcgtaaacgccagcgagcgcaccagaaccatcaattggtacggcggaagtaacgtagatcgtcgcgttagtgacgcctgcggttaatgccgcatttttatattggttcgcggtaattgttgtgatattgttgctgccgttaaaatcgacaatcttaacgttaataccggtattgctattattcttttgaatcaacgcactagaatagacgttggaattcgcgttaaaagtttgttgattttgatcgagatatttaacgagggttgaaccggtgactgttaattcatcagaatcggtgatgttagcggcgttttgaagcgttgagagggtttctgatttttgcgtacttgaaagacttgttccgagtgttgcgactggtttatcccaagtattactgtcggcaaaaacgctgtgggcgctgaggcctaaaatagccgtcatgacgattgggagaatgtatttgagtttattaaacatttaattattttttaagggatgctctccttgcggttgaaccaaactcatttcttgggtcttggttaacttctcataaaagagttgcggctttttgaaaagccacgataataggaagttacccgtgaataagacgggtggtaaggcagccagaccgcctagtagaaggtagatatctaaatgcgtttggccgctagcaaccaaggcatcgatggtgatccgccataattggaaactaggtaggatgataaagaacagtaaaaattggcgactgaatatccgccaagcaatggcattttcggcggtgatttttaacctcaagagcgctttaccaggtgtctgcccccgccagaggacgggcagtaagacgaagtagagtccgttttctaaacaatagtagaaaacatcattgccaaaagtaggtagttttaataaacgccaaatcgctgtaacaattatgccaatcagtgttaagagacaataatcgattcccagtgctaataagcgacggagataaccaactttttggccgttgatgtaagccgcttgatcaagtgcatcacgagtcggcaagaaataggttaataagggtgctaagccgaagccgatgagtccgccactcgtgtttagcagtagatcatcaacatcgaataaccgatatggtcgggggtaaataccatagagtcctgacagctgggttaattcgaagaataatgtgaggccaaaacttaataatagggtctgtttgaatgatgtccggaagaagtaacgaaggtaaacaccaaaggggatggttaaaacgatattaaagagcggttgaatcgtcgccgcttgtttaagcgttgcgagataggttgccggttgattccaaacccagtgtgtcgtgttaataaattcacggacaaaagtgaacggcactaggttataacgcggggtcgtcaaatgagcgacgactgattttggtggtaaggggagtataatgagacagtaggcggctaataagtagaagataaagctataaatcactaagcttcgccaaaaggttagtgcgccaaaacgccggtaatgatagattaaaaccggaattgtgagggcgattgcgacaaacggaaaaaccgtcgctgcggtgatgatattatcgagatatagcatatgacatctgcagtagtagttggaacacaatggggcgacgaaggtaaggggaaaatcaccgactttttaggtcagaatgctgacgcaatcgctcgttatcaaggtggagacaatgcaggccacaccatcaaattaggcgaagatacttatcatttacaattaattccatctgggatttttaacagtgataaggtcagcgtcatcggtaacggggttgtggttaatcctaaatcactcgttggcgaattacgtggtttagctgacaagaatgtagatacaagtcaattgaaattatcagatcgggcccacgtcatcttgccttatcacattaagctagatggcttacaagaggccgctaagggtgatcaaaagattggaacgactaatcgtgggatcggcccagcttatatggataaagcagctagaagtggtattcgtgtggctgatctattagataaagatttatttgcaactaaattaaaacaaaacttagctgaaaaaaatgccttatttacaaagatttatgaagttgaagctttagatttcgactcaatttttgaagaatactaccaatatggtcaagaattaaaacaatacgtttgtgatacatctgttgttttaaatgatgttttagatcaaaagggcaacgtcttattcgaaggggcccaaggtattttattggatatcgaccaagggacttacccatttgtaacttcttcaaatcctgccggtggcgtttcaactggttcaggggtcggcgcttcacggattgatgaagtggtcggggttgctaaagcttatacatcacgtgttggtgatggcccattcccaactgaattattcgatgaaacgggtgatttcattcgtcaagcaggccacgaatacggcactgttacaggacgtccacggcgaattggttggtttgatacagttgtgcttcgtcattctaaacgggtggctggcttaacgcaactttgtttaaactgtgttgatgttttaactggtttgaagacgttgaaaatctgtgtcgcttacgaattagacggtgaacgcatcgatcgttacccagcaagcttgagcgaattagcacgttgtacaccaatctatgaagaattacctggttgggatgaagatattactggcgttaagacacttgaagaattaccagtcaatgcgcgtcggtatgttgaacgcttgcaagaattggttgatttaccattagccacatttgcggttggtcccgatcgtgatcaaacaaacattttaaaagcaatctggtaaatggaaaaagtaagtcgtttcttcggtatcgaagaacaacattcaacggtccaacgggaaattctagccggattcaccacgtttatttcaatggtttacattttatttgttaatccaagcgttttgggtgcttcagggatggataaaggggccgttttcgcggcgactgctttagccagtgccatcgggtgtttcttgatgggcttgtacgctaaatatccaatcgcaacagctcccgcacttgggattaacgcgttttttagttattcagtagtcattgggatgggtgtttcatggcaaacggcactcgcaggtgtgtttgtcgcttcattgattttcatggtaatcactatttttaaattacgtgaaatcattattgatgcgattccgcgcgatcttaaattagcaatttcggccgggattgggatgtttgtggcttttatcggcttacatggcggtggtttaatcgtcgccaataaatcaacagtcgtgggtcttggggacttctcacaaggcacgacttggttaacagtttttggcttgattattacaattattttaatggttaaaaaagtaccaggtgcgatttttattggaatggtcttaacttctattttaggggccgtaacgggtttaattaagttaccaactcattttgtcgctgccgcacctagtttaaaaccaacattcctagctggtttgaatcatgttggggatattaatacggttcaaatgtgggtggttgtcttgacgttcttattagtgacgttcttcgatacagcgggcacattggttggtttagctgaacaagctggtttcatgaaggacaacaagatgccacgtgttgggaaagccttgatgtcagattcttcagcaatgttggctggttcactcttggggacatcacctgttggggccttcgtcgaatcgtcagccgggattgccgttggtggtcggactggtttaacagcagtggttaccgggattttattcgtcttcagtttattcttctcaccacttttaacggtggtgacgtcacaagtaacggcgccggctttagtaattgttggggtgttaatggcgcaatcattgaagaaaattgactgggaaaaattggaaatcgcgattccagctttcttaatcgttttggggatgcctttaacttacagtatttcagatgggattgctttagggtttatcgtttacccaatcacgatgattacggctggtcgtcgtaaggaaattcatccaattatgtacgtgctctttttcgtattcgtaatctttatgtatattctaaacgtcggttaaatgaaaattcaaatcctatttttgaaattagtttgtggcttagccagcttaccgctaatctttatcgggttgattgggccacggttaacgcataaaattgcgcagaacttcccccaaattccgggtggcttgtggttggtcgttctcttggtttatgggtcattgatcctggtactttgggggttgtaccaactccaacgaattttacgcgaggtcgatctggtcggtcattttggccagcagacacaacaagccctccgccaaattcaaaaagtcgccagtatcaatggcgcggcctatctcttgagcttaccattattctatttaattgcagtcagacaagcgacaccgggtgtcatgttgattgacctagggttagttgttatctcactggcaattgcgattaccgctaatttatttcgaaatttaatgcatccggcaattattgtggaaaaataagtgcaaaaaaagacgaagaatcggcttattaatagtctgctagcacttttattgctcattggtttaatacttgtttttattggcccaattcgcaatcaaatggttaaatcaatggctaatcgccggatgaatacggtgacggccgctcaaattaagaaaaaccaacataaaaaggctaattttgatttcaatagtgttaaaacactcgatacaaagcaaatcgtcagcgccgccgttaagggcgatgtgattgttttagggaaggttgcggttccgagcgtcggaattgcattgccggtcatgaagggcgtctcagaagcaacaatggcccaaggcggtggtacgatgaaacctgaccagaagatgggtgccgataataactatgccttagccggtcattcatttaccaacatctttttaccattggaaaatgttaaagtcggcgatatggtttacctaactgatttacaaaacgtctattcataccgcgtaaacgttaaaaaatcgattgcccctgaagaagtcaaagtaatcgatgatgtcccgggacataaaatggtcaccttaattacctgtgatcaaacggttcgtcggtggtgcgtccaaggcgaattagtgaagactgaaaaagcgaataagacgaatttaaaagtatttggctaattaaaaaataacggtcagtaagctaccaactacaaaaattaaaataaataaccatattattttaccaattggatggttagggttgattgtcaggccgattccaacgaccttaggaatcaagaggggctgcttatttccaggctgtttagagtagaattgaactgttttaaagtagctcaagataacgaggattgttgtaaaaactaagactaagagcccagttaactgttcattgaccagtgatttgaaaaaaatcgtagctagaatgatgatgaccaatcccgataaagtaagcaacaaggcataatctaataagtgtgtctttttttgttgattaattaactggtaatcgttagcgactttattgagatagttggtgtcttgcttcaacatatcgtcgagtgataaatcatatagattactaatggcgaccagcattgggacgtcgggatagtttttaccgttttcccagttcgaaatagtctgtcgacttgtgtgaagctgatctgcgacagcttgttgagttaaatgtagatcaatacgacgttttttaagcgtagtggctaacatatgaaatatggctatgcaagagtgtctacgatgggccagaatttagatacacaaatcgagcaactaaagcaggccgattgtgataaaatctattccgaaaaattcacagggacgacaactgatcggcctaagtttaagttgcttctaaaaaagttaaaaccgggcgatacgctaatagtgacaaaattagaccgattcgcgcgtaatacaattggggctttaagtattacgaaagagttgtttgcgcgtaatatcaaggtgacgattttaaatatggggaccattgaagatacccccacaggaaacctaatgctaacgatgctgagtgcctttgcgcaatttgagcgggatatgattgtgacgcggacacaagaaggtaaggaagctgcgcggatgaataacccactctatcatgaaggccggcggcaaaagtatacagatcagcaaattgaaggcgcactgaaggatgttgaaaaaggtttaaccatccaagagattagtttaaaaacaggaattagtatttcgacgctaagacgtcgtgccgtgaaggcctaaatggctaaaaaaatattggtagttgatgatgaaaaacccatctcggatatcgttaagtttaatctaacgaaagagggctatgatgtttacacagcttatgatggggaagaagcactacaacaagtagaagaagttgtccctgacttaattctattagatttgatgttacctaaggttgacggtcttgaagtcgctcgccaggtacgcaaatcacacgatatgccaattattatggtaacagctaaagattcagaaattgataaagtgatagggctagaattaggcgctgatgattatgtcacaaaacctttttccaatcgtgaattggttgcccgtgttaaagcaaatttaagacgccaagggtcaaccagtcaatctgataaagaagcaaatgaggaaaaccacgaaattaacattggcgacctcacgattcacccagaagcttatattgtgtctaaacggggcacgaagattgaattaacacatcgtgaattcgaattattacattacttagccaaacatattgggcaagtaatgacgcgcgaacatttattacaaacagtttggggttatgactactttggtgatgtgcgcacagtggatgtcacagtccgtcgtttacgtgagaagattgaagataatcctagtcatccagaatggttagtaacgcgtcgtggtgttggttattatttaagaaatcctgagcaggagtaaatgaataaaaaaattcggttattccaatcaatccatttcaagattgcaattgtttttgtcttgttgctgctagtaacactagaggtgattggggcttcgtttgttaagcaattggaataccaaaatgtgaaagattttaagcagtcattgcaagtgactccctatgttcaaaaccaattaagcaatgaattgatgagcaatagcggtaatgcgaataaaaatatcaaggatattatcggcgatatgggcaattctgctgagattcaagtcgttgataataaagggaccattcggggtgtcactaatctgaatacgcaaagtactgttggtcaaaaaacgcgtaatccacgtgtgaaacaggcgatttattcagggcatacggaacaagaagttgcctatagtgaaagccagggcagttattatacggcgattcaaccgttgacggatcccaatggtgacagcaatactgtcgttggggcagtctatattcgtgccagcatggaagaggtctataaaggcatttcatcgatcacggttattttcctgacctcgtctcttgtggcaggtttattagggatggctttatcgattgtcatttcccgggcaataacgcgtccaattgatgaaatgaagaaacaagcaattcagatggcacgtggcgattattcaggccaggtccgcatctatggacaggatgaattgggccaacttgcgattgcggttaataacttgtcagttcgggtcgaagaggcgcaagaagcgtccgaatccgagcgacggcgattagatagcgttatgagtcacatgactgatggggtaattgcgactgatcgacgaggtaatatcacgattattaatgaaaccgggcaggactttctcaatgtgactagcgatggcgtcttgggccaatcgcttctaaaagtgcttaaaattagtgaagaatatacacttcgcgatttattagaaacccaacaagtgatggtcttagatttttcagatcaacaagatcatgacttgattttgcatgtcgatttttcattgattcaaagagaaacaggctatatcaccgggttagtgtgtgtgttacatgatgtaacggaacaacaaaagaatgaacgtgaacaacgcgaattcgtttcaaatgtttctcacgaattgcggacaccattgacgagtgttcggagttacatcgaagcccttaatgatggtgcttggcaagatcctgaagtcgcaccgaactttttgaaggttacgcaagaagaaactgatcgaatgatccgaatgattaacgatttattgagtttatcgcggatggaccaagggacagctaaaatgaatttagaatttgttaatttaaatgaattctttggctatgtacttgatcggtttgatatgatgattaaacgggatcaggaacacgataacaatgcatcaccgagagggacgggcaagttaccaactgatgatcctaataaaaaatacagtattacgcgcgacttcaccaagcgggatttatgggtcgaaattgataccgataaattcatgcaggtagtcgataatattatgaataatgcgattaagtattcaccagatggtggggtcatcacttgtcgtttattggaaacccatcgtcatgtgatcttaagcatttctgatcagggcttagggattccacgtaaagatttagggaaaatcttcgatcgtttctaccgggttgataaggcgcgctctcggaaacaaggcgggaccggtttaggcttggcaatttcaaaagaagttatcgaagcacataatgggcgtgtttgggttgatagccaagaaggcaaaggctcaacattctatatttctttaccatacgaaccaattgattctgatggaggtgattgggatgaaatttaaatgaaatttaatagttttgtgatgcgggtcatcctgattgcttcaatcgttttaagtattattttatcctggaagatttggacgaataatacacattacgaacgacggacagatagtcaaacgacgacgaaagcggtgagtcgaaaatcggatcgcaagattagcgatatctttttacccacgcaaatcctgtggcggactaatcaacagagtcagctcgtttataattcaaaagaaagcttagtgcccaagctgaaggaagccatgaagttgactaaatcagcacggtttaaagcatctaagttaagtgaagccaattactatcaggcgattacaactgatgatacattgaccttgttgtatccggacaatatttcgtatgcggtctttaagaaggtttttgacgacagtaacaaccaattgagccggaatacgacctttaatcggattaagattacgatggggaataagccacagctgacattgatgaacgataagagtcacatgacttatcaaacgacgatgcggcaattttcagaggcccaagtgaaacgtattttggatcattcagatgtacacttgaatgttaaggagagtttgttaaatcataaaccgtttatttatgtggctgccgatcagtcccttttaccatatagttacttagtcaaccaacaaccagaaaattactatattacgaccctattggatcaaaaaaatactgataatattgatgctaaagaacaaggggacaatgtaatctatacagatggtgccaataacgatttatacaagcgactaaccatcaatcataaaacgggtgaaattgcatttgtgaaatatgaggatacgaagtcaccgacaggcttaacgaagagttttgaaacgagttttgctgcgttgttgaagacgggcaattcattatccggcatgcgtttttacagttatgatgaagataccaattcgacgacttatcgcacctatgttgaaggcttcccagtcttttaccaaactaattttgggagtgttaaggtgcagttattaccaaccggtcaacgggtcgatttttcaaattatagtttacaagtgccggtaccagcaggcgataagccggtcgctttaccaagtacgcaagccgtcttaaatcagatgactaaaaatggtttcttactagagaatatcgataatattcaggttggctatgaatggacgcaagaaacaagtaacaatcaagtgattgatcttaatccaacttattttattcaatataaaggcgtttggcgtagtcttagcgcattattagcacagaaagcggaattaaccgaagggagctagatggattttcgcagaattgaaatgatttttattgccatttttattgcgctcgatatctatttgtttatgtcacttggtggtagtcaaacgaccaattcggcttctattacgaatcgttcgcaaaccagtcagattttaaaagatttaaaggatgatcagattactgttaaaagattatcgaatcaaaaacgcgagagttattatttagcgagtcgtcaagcagatcaaacaggtttagcgacagccagtgctaaattaacggggcagacggtctcgtttgataaaacaagattaaccctgacaagtgttctcgataagcccttgagttataaaaaagggagggcgacagccgttattaatacttttttgaaaggtaataataatgtttaccaagccgatcaatatcggtattcaaaagcgttatcgaataatcagcaagctgtttacgtccaaaaggtcccaggggggcaaatgatggacgaacatggacagttaatttttacattggataacggacaaattagccagtatacgcagacttatatcaataaggttcaaattttacgtgaaaaggaaatgaccaagatttctgcacaaggggcagtcgtcgatttatacacggataatgaaattccaaataactccaagattttgtgggttcaactaggctatagcgccctattagacgccaatagcagtacggtctacgtaccagcctggcaaatcgccattgaaaataagagtaccaaaaacgtcgtcgttaagcgcatcaatgcgttcaccggcgccttaatgaagaatcgcagcgaagtaacatcataaatggtagaaaaagatgaaatgcgggttagcgtcttagccagcagtagttcaggcaacacaacttttattgaaacaccaactcaaaaaatattagtcgacgcgggaatgagcggtaaacgcgttcaggatttaatgcacagtatcggtcgggatttaaaggatgttgacagtctactagtgacgcacgaacatcgcgatcacagtagtggcgtgggtgttttagcccgccggtatgggattgatgtgtatgctaaccaaccgacttgggatgcgatggcgtcaattattgggaccgttcctgatgaacataagcacgtctttgagatgggtaaaaccaaaacactcggtgatatcgatgttgaaagttatggcgtttcacacgatgccgctgcggcgcaattctatcaatttcatcataataaccgagccttcgcaatcttaacggatacgggttacgtttcggatcaaatcagaggcactatcgaaaatgcggatgcctacttggtggaatgtaatcacgatttggaaatgttacgaatgggtaagtacccttggtcgcttaaacaacgtattcttagtgatacgggtcatctatctaacgaagatggggcttcagccttaatggcctttatgggacaacaaacaaagcgtgttttcctaggtcatttgagccaagaaaacaatatgaaggagttggcacacttaacggtggcatcaattttagaacaacatgattacggtgttggcacggattttgaaattttggatactgatccagcgattgcggaccctttatttgttgtttagatgaatcaaaattcaggattaatgaaaacagcggttgttgcagttatttcagcattgattggtgggggcgcagcctatgccggtttttctcgactcggcagttcggccaatgatgtcacgactgcaacgcagacgcctactaaagcgggggcaactaagattagtaatatcaaagtgaactcatcatcacagacgacaacagccttccaaaaggttaatacatcagttgtatccgttgtgaacttacaaaaacaacaacaatcaaccggtgacctgagttcattatttggttcaggcagcaccaacagcaatagtagttcttctaagagcagtagcagtgatttagaagaatccagtgaaggttcaggtttaatctacgagaaaaaagacggcaaagcttacatcgtgacgaataatcacgtggttgctggttctgataaaatcgaagtcattttgagtgatggcacaaaattggaagctagtttagttgggacagatgctgtttctgatttggctgtcttaaaaattaacgggactaaagtgaagaagacggcaacgtttggtgattcagatagtatcaaagctggtgaatcagttcttgcgatcggctcaccattgggttcagaatacgcaacttctgtcacacaagggatcatttctgctaagaaacggacaattgatgtgacggacgaaacaactggccaaacaactggtcaagcgactgttattcaaactgatacagcgattaaccctgggaactcaggtggcccattagttaatatggccggtcaagttgttgggattaattcaatgaagttagcctcaaatggtgatacgacagttgaagggatgggctttgctattccaagtaacgaagttgttaaaattattaatcaattagtggctaacgggaaagtcgttagaccagcacttgggattagtgtgatagatttaaccaatatttcatcaacacaacaatcttcagtattaaaactaccatcaaccgtcaatagcggggtagtggttgcctcagtaacaagcaattcagttgctaagaaagctgggattagtaaatacgatgtgattgtcggtttaggcggcaagacggtttcaagcgttgcagacttacacacaatcctatacagttacgcgatgaatagtacaactgaaattcagtactaccataatggcagcttgaaaaaagcgaatgttaaacttacacaagcagcttcatcagatagtacgacaacaactaaataaatgaatatcaaaattatcacagttgggaaactgaaagaaaaatacttgaaggcgggcattgcggaatacgccaaacgcttaagcaaattttgtaagtttgaaatcatcgaagtgtcagacgaaaaggcaccggaatctttgagtgaggctgaaatgacgaccgttaaagataaagaaggcgaacggatcttagccaaggtgaaggataaggaacacgtgattgtgttagccattcacggcaagcaacgtgcgtcagaagaattcgcaaaagaaatccaagatttggcaacctatggcacatcagatatcactttcattattgggggctcactcggaacaagcgatgccgtcaataaacgtgctaacgatgcactatcgtttggcaaattaacgttaccccatcaattgatgcgcttagttttaacggaacagatttaccgggcgtttatgattaaccagggatctccgtatcacaaataaatgaataagaaattaacggttggtttagcaacggcgacgcttcttttgttggcggcgtgtgggcaacaggctgattcaacgaagacaagtagcaacagtcacagtacgacgcaatcggaaaaacgggctaaaaagcaaagtgaattaaaattgcgggctcaaagtagcgccaaaaaacaggcttcagaagcgtcagctaaagcgatgagcgagtctcgtgaaaaggccgcgattgcatcatcaatagcagctgctcaatcggctgaagttgcaagcagtacagccgctagtgaacaagcggcatctgcaagttcagcgtctgctgctcaacaagcatcagaaacggtagcttctaaagcaagtgaatcacaacaagcagcggaacaagctaagcaatctgcaattaaaccgatcacacaagcagaggcgattgaagctgaaaaaaaggcgttcgaaggtgctgaagttattgtttcgcataacggcactttcagtagtcaacctgatggttcaatgacggctcatgactattctggggcgcagggggaagatttctggaccttcacgccgaatgcagacggtacgattacggttctttcgaagtttggttccgtcaaaggtggcgaacaacaaatcgaaacgcatgtggtgccaagataattatttttgcaagtaatctgcgacataagcgtcgatttctgcgaggtaggtttgtttttgggaatcactaatccacgctgtttcaaatgagttctttgcaaactgaacgacttggtcaatagttaaatcatttttagtagcgatagcttcgtaattatcgttgatatagccgccaaaataagctggatcgtcagaattaattgagactttgacattgtgatcgatcagttcgagaacttctcgatccttcatatcatcggcaacaaggcggttagaaagtgggcaagaagttaagccgattttaagctgttcgacccagtcaaccaggtccggattttcgacgatattggtaccgtgatcgaggcgttcaacgcgaatgatttcgagggcttgttgaatgtgttggattgagtccacttgatcgatatcggcatgcatcgtaatccgataaccttgagcaaccgcatcgccgtattctctaaggaacttcaatggtggattgtgatgttcatcggagtctaaaccgataccgagaatcttagcttggtagggtttggcgatttctagtagttggcgcgctgactctgtggaaagatcgcggaggaaacacatgattaagtgggcatcgacattgaaggcacgggcatcgacacaggcacgataaaagccgttcacgacggcttcaaaagctacactgcgtgtcatatgagcttggggatcaaagaacaattcggcgtaacggatattttcttggtgggcctttttcaaataagttaacgctaattggtagaagtcatcttcagtttgtaaaacattcattgcggggtaataaactgcgagaaatgatgcgagtgaattgaagttgtagcttgcttgaacttcttcaatcgtagtttggccgatatcaacaccatttttttgcgcaagggctaatttcaattcgggttccaatgtgccttccaagtgaagatgtaattctgctttaggtaaaccatcaataaagtcacgtgttgccaattgtgtcatatggcaccaatgaagcaatcagggattcaagcaagcgcagatcgcatgtttaagttacaagaatctggcacaacaatgaaacgcgaaattttcgcgggactgacaacgtttgtctcgatggcttatattctattcgttaatccacagattttaggcgaagccggtatggataaaggcgcagtcttcacagcgaccgctctttcagcaattgttggttcgttattaatggcctttttagccaattatccaatcgcgattgccccaggacttggcgataacgcgtttttcacatattcagtcgtcattgctatgggcatttcttggcagaccgctatggcaggtgtcgtggtcgcatcattgatttttatggtgattaccttattcaaggttcgggaatacattattgacgcgattccacatgatttgaaactagcgatggccgccggaattggcctgttcatcgcgtttgtcgggttacaaggtggcggtttagttgttgccagcaaatcaaccctcgttcaaatggggtcattcacagtgccgacaacttggctcacgattttcggtttaatcgtgaccggcgtattgatggctaaaaaggtaaatggtgccatctttattgggatgattgcgaccacgattttaggcttagtgacaaaattaatttcgttaccagcacaattgatgtcagttgcaccaagtatgaaacccacgtttggcgtagggatccaacacttaggtgatatcaatcaaccacaattatgggcagtcgttttaattttcttattggtagctttctttgatactgccgggactttaatcggtttggcagaacaagctggcttcatgaaaaatggtaaaatgccccgtattggccaagcgttaatggctgattctgtttcaatgatggccgggtcagtaatgggcacaacaccaactgccgcttatgttgaatcatccgctgggattgccatgggtggtaagacgggtttgactagtttagtggttagtgtattgttcgggttttcgatgttattctcaccattattaacagtcgttacatcacaagtgaccgcgcctgttttaattatcgttggtgttttaatggcaagctcattaagtaagattgattggagtcgctttgaagtggcgttaccaagtttcttaacgattatcgcaatgccgctgacttacaatatcgcttacgggattgcttttggcttcttagtttacccagtgacaatgcttgctgcgggtcggcgcaaggaaattcatccggccatgtacgctttattcgttgtttttgttatcttgttgtacgtcattaatatcttaccgaaataaatgtcagatcgcttaacggcttttaaagaattaattcaagctgggggtgctaagcggcccgcagacctcattattaaaaatggtcagttagtcaatgtgatgaccgccgaaatttatccggcagaagtcgctgtttaccaaggtaaaattgtagcggtagatcccgatgtttcagcgtatcaagggactgaaacgcgtgtgattgatgctaagcagcaatacatcgtaccgggcttgattgacggtcacatccatgtagaatgcagtaagttaagtatgactagttttgctgaggccgttgtcccacacggcacaaccagtattatttcaggattagacgaatatatctcagtaatcggtgtcgacggtttatcagaaatttttaaagaagttgatcaattaccaatgcgcgttttctggggcgcgccattcaagaccccttacacgattccagcttctaccatcgctgataatattgattcaacggttcaagcgcaactacaaaaacggtctgacgtttatggcgtttgggaaacggtgcgtgaagcagttgaaacactagacgaagataccttaaaaacattattgagtgcgcaagataaccacgtacccgtttggggctgcgcgccaatggcaacgggcactaagttgaacgaatacttgatgagtggcgtccgggtcgatcacgagagttacgaccaccaagaattattggaaaaggttcgcaaagggatcaacgttgtgattcgtgaatcatcagtgacgcatttcttagctgaaaatattcgcgccatcactgaaacaaacggtcagattgcacggcatgtcagtttttgtacggatgacgttaacgcaatggatatcgtcaataaaggtcatctcgatcatttagtacgtttggcaatcgcggctggggttgcaccaatgacggccatccaaatggcgacgatcaatagcgctgaagcctaccgcattgatgatcaagtcggcttaatcgcaccagggcgcaatgcggatatcttattggtttctgatttggaagcttttgagattacacgcgtcttggctaaaggtcaaccggtggcaacggacgggcacatcgatcatagtattgaacgcccggttcgcccggctagtttagctaacactgttatcagagaggctgtccaagctagcgactttgaatatcatgtggcagcagatgcaagtcaggtcactgttcaaacgattgccagcgaaggaccttttgtccgccatgctaagactaagatgttagcggttgaagatgggattgttcaaatcgatccagcaaaagacgttgcgttgatttccgtcttggaacgtttcggtaaaaatggcaaccaatcattaggattcacctcgggttggacgctcaaaaaaggtgcgatggcttcgaccgccgcacccgatgataacaacattatcgtgatgggtgttaatccagacgatatggctttggcggtcaatacgttgatcgaacgtgatggtggccaagtggttgtggctgatggtcagattttaagtttcttaccattaccaatcgccgggattgtcagcgatgtaacgccagctgaattggcagttcaagaagaaggcattttaaaagccagccaagctattgggagtgaagtggtcgatccgatgttttatatgacgttcttaccaattacagcgattcccgatttagccattactgatttaggaaacgttgattgtaatgaattaagactatttgacccgatattaacaactcaatagttaggcgagtggttgtccgtccgcttcttgatagcgttgtaagatgtaaatcgcgagaatcactaagatcgccccgctcatttcaacccagctgaattttgagtggaagaaaatgatgctgaggatgaaggtgattacgggttgcacggcatctacgatactgattacggttgatggtgcgaaatttaaactgtgtaataaacaaagataagcaaaaaccgttccgattaaaatgacagctaagattgcaataatcccagaaccatttaaatgaggtggtgcttgccagaatgggcggttgatgttgaataaaatcccactgataaacatcccccaaccaagcactaaaatcggtgatttttcattgacgatagggcgtggtaaaacaacgtaaaacgctgctgtgacccctgataaaatcccccagattaatgaattaaacggaattgtcaatgtatgaatattcccttttgtaattgagaggaaaacccctactaaggcaattccaaatgaaatcaaatcaattcggttaggccacttgcgaacaaaggcgagcgtcccaattacgatgaaaagtgggctcaagtattgcaaaatagtagccgctgcggcgttcccagtttgaatactcatgaagaaggtgtattgattccccataatcccaaaaagcgcgtaggcgattaaccaggctgtcaatcgcttagatttaaagattgagaagatatcttgtttgaacttaatcgcaccgattagtaaaagaattagaccggcacctaaggttctaacagataagaaccaagtcgcagggactttttgcccttgcgagataaattcgaggattgtcccagagacgccccaaagtgcagaagccatggttgcccaaaacatccctttagcgatgttttgcggctttagttgatttgtcatatgaaaaaacgtctgaaacaaggaacggtcattctcctaggagtcatcttagcggggctgctcctttttaaattagtaggaagctcatcgttatttaacaaggatatattgagtacatctcagattatcaaaaacattggtagtcagacaatcaagacgcggcaaacgcgtcaggaaaaattaaccgcgacttataaaaaagcacttaaatcggatcaatatacgagcgctaagccctatgttaaggtcaatccttatgggacgtcacctctgagtgcgttggtgttgtttaaaacaaatacggcgactaaggtcacggtcgaagtggtggggaaaaccgctaagaccagtattaagagtgaagttggcaaaacttacaccaagagtcataccatttcagttttagggctttatgcgaactatcaaaataaggtgcgcttaacattaacggataaagctggccataagacgtatcaaacgattactgtcaaaacagccgctttaccgaaagcaattgcttcgatgtcattgaaggtcaaaaaagcggataagacgaagatgtcaattggcaatagcagtctaacgttcttagtgcgttcaacacaatatccagttggtgtcgatgcggatggtgaaattcggtggtattcaaccaattatgtccaacatatttttaaagtactcagcaacggccatcttctttatttaacgaaacctgataataaagatttagtctacaatgatttgttggaaactgattttatgggacgtgtttatcgcgaataccaattctcgacggaaacgcgtaacaatgaatcggcaaatgataaaaccgaaacaaccattattcaccatgatgcgattgaattaccgaaccataacttattgctgacggtttcggatgggggttcaaaatatgttgaggatacaatggtcgagttatcacgtaaaaccggcaaagtggtcaaagtgattgatttgaagaagcttttaccagctgagctctatgaaacctataaggcgacaaaacgtgccgatggcaagttagattggttccaccaaaattcaatcgactatgataccagtgatgatagcatcgttatttcaagtcgcaatcaggatttagtcatgaaactagattacaagacatctaaaattaagtggttattcagtagtaaatcggctagcaagtggccattgaaataccgtaaattattgttgaaagctgccgacagccaaacaacctttacgggtgggcaacacgccgccacaatttggccgaccggcgaagcggaccagaagcaactagtgttgttcaacaataatatggccgtttcaaatggcgataagaagacgtctggcaagtactccgagggtgtcagctatttaattgatgaacaggataagacgattaagaaaacctggtcctacggcaaaacattgggtaaaacgaattttagtgaagtaatcggctgtacgcgtaaattaacaaatggcgattacttgattgattttgggtttaacgatcaaggcaagaccagtcgtattgtagaggtggatcccaaaactaataaagtggtctataatttgacgtttaccaattttacgacaattggttatgcttatcgggccgaacggttctcactatatagtcagaattatcaatttaagttatgaatgcagtatatcgcattattacggggaattaatgttggcggtaagcgaaaagttcagatgaacttgttacggaccgcgtttgaagatgccgggtttacgaatgtgcggacctatattaatagtggtaatgtgttatttgaaacacccgaaacagaactgacggaattggtggcggtttgtgatcaattgatggtcacgacgtttggcttttcagtccgaattgcaattgttacggctgattatgagcaggttgctgttacggggcagtttgttttctggagtgcacctgttaagacacacgggcgcacgcgctgggcgacaattgttaaaaataaggcactttaccagtggattacaatccgcaatgccaacaccgctcggaaattagcagctttagcacaagactagatgcgtttatcaaatttgaaacagacgatgctgcaaatgggtttaatcttaattgcgttagaaataattgcaattgggatccaactcttctttgccccccacgaagtagcagccggtggggcaaccggtgtgggaattttattagaggaattaatgggctggcggatttcgacggtggtcttagtgatcaacatcgggatgctgatcttagcttattttctcctcgataaaaagaccacgttaagaatcctctttggtagttttatgttaccagtttgtttggccatcactccgcaggcgatggtggttgaagataaactgttggcgattattatcgggagtgtggtatatgctgccggaatcgccttgttatatcgaattgatgcatctagtggcgggtcaaccgtgccaccattaatttttaagaagtatttcaatattaaaccagcattaagcttgttggtcgttgatttattagtttgttttgccaatgtttttgtttctggtttcgaaacctttatgttagcaacctgttcatcgattttgacattgattacgatgaattatatcgaaacaggtcttaaccggaaaaaagtgctctacgtgatgagtaacgaacagttggcaactatcaaagaacatttggtggaagaagctgatgtcggtgtgacaatctttgacgtaacaggtggttactctaacgaagacaagcaaatgttgatgttagtggtcgaaaatcaggcctaccaacacatcattaataaaattcacgaagtggacccgctagcgtttacgatagtcggcaacatagcagaagtccgtggcggcagtttataatcacgaagtggacccgctagcgtttacgatagtcggcaacatagcagaagtccgtggcggcagtttataaaaataagcgtgcgttttaaacaataaaaaaggggttgggacaaaatttatttttgtcccaaccccttttttgatacccgaatttttatagtctaaacgtgttatataagtcatatccttgtggttaacgccgaatgtcaaacgattgcttacagcaatcatttacagatggttaaaatagcgttccgcttttaaattttggacggtgagcatcacgacgaagctgattagatagagcgtcgagatgaataacatgacggttagaatggaatagtgatccagtaaccagccgataatgacgcttgaaaacccaccgacacagcgaccaacgttcatgatgacgttattggcagttgcccgaacttcggcggggtagaggcgactaacaatcgctccgtagccggcgaacatcccgtttgaaaaatagccgacaagcgcaccgacaatcaagaggccggtcatatttttaggtaaggtcaacacgtagacgccagctgcagaagcgagtaagaagccgctaaaagcaacgcgggggccgatgcgatcgagaatccaaccaaaggttaacataccggctgacatcccgacaattgttgcgagcatccaggtggaagagccagcaacactgaggtgtaactgttgttgcatcattgttggcaaccagttcattaacccgaagtacccagcgatttgaaccactgccataaccattaaagctaatgtttgatgcgttaattgacgcgttttgaagagggctttaatttggcctttaggtcgtgcttcgtcggtgtcaaagctgcgactttcgactaagtgatgccgaatgaagaaggtgataatcactgggaataatccgaataaaaatagtgcgtgccaaccgtattgaggcaatacccaagcggccaaaagtgaggcggcaattgcgcctaattgaccggcaacaccgacgtacgacgaaacgcgcccgagttgttttttgggaaagctttccgcaagaacggtcatgccaatcccatattcaccaccagcaccaatcccggctaaaaagcgacaaaggtagatgagggtgagtgaatttgcgaaatacattgctgccgtagcaaaggcgaagataaaaatcgtgtaggtgaacgtcttaatgcgcccgacgcgatcggctaaaacgccaaaaaaaacgccacctaacaacatcccgatattagtaatcgttgcgatcagtcctgcttgggtgccgctgaggtgtaactcagcaataatggacgataaggcaaaagacaagaacataacgtccatgttttcgagtccgaacccggcggtcgttgaggcgaccaccttagactggtagcttgttaatcgatgttggctgtgtgccgtgatagttttcatatggcaacgaagaaacgacatcattttacttttccaagcgcctatacggtgattttattggtcttattattagtgatgattttgacctatttcatgccgtctgggaagtacgcgagtttacaatataatacccaaagcaataattttaccattactagcccaaccggccgcgaatcaacggctcccgggacgcaagcaacactcaagaagtaccatgttaatacgagtttagcgaaatttaaggatggctccgtatacaaacccgtagcgattccgaatacgtatcaacatttgaaaaaagccaacaccggcctttttggtgcggttaagcagttcttgaatgcgcctattcaaggcttggctgaaacaatcgatattataaccttcgtacttattttagggggaattgtgggcgtcgtgaataaaaccggggcatttgctgccggaatggctgccctatctaagaagttaaaaggccgtgaagcttggttgatcgtgattgtgacgagtttaatcgcactcggggggaccactttcggtcttgccgaagaaacgattgccttttatcccattttagtgccaattttcatggcggctggctacgatgcgctggtcgcaatcgccgcgatttatttaggtagttcaatcgggacaatggcgtcaacggtgaacccgttctcagttgttatcgcgtcgaacactgccgggattagttttacagaagggatgggcctcagaatcgtgatgctcgtcatcgggactgcgatgtgtatcttctataccattcgctatgctgaaaaagtaaaaaaggatcctgaaaaatcattaatttatagtcaaaaagcagaattagaagctcatttcttgggtgatcaagaaaataacgtcgtgcctaagtttgatttccggaagaaattaatgttgatcatctttgcggccggttttgtcatcatggtctttggcgttaaggaatggggctggctcttcaatgaaatttcggccttattcttggccattacctttattttagccttcatttctggcttatcggaaaaagacttcgtgggtgaatttgtggccggcgcttctgatttactaggagttgccttggtcatcgcccttgcacggggtgtgacgattatcatggaacaagctcagattagtgatacgttacttttctggctcagcaatggggtttcacatatgagtggggtcatcttctcaaccgtgatgttcttcgtcttcatcctattagggttctttatcccatcgagttccggcttggctgtcctttcgatgccggtcatggcaccgttggccgatgtggttggcgttcaccgcgatgtgattatcagtgcctataactgggggcaagggatcatgtcatttatcacaccaactggtttggttttagcatccttagcgatggtccatgtcacgttcgataaatggttgaagtttgtgctaccattgatgttagcaatcggtctgttagctatgattttactcggcatcagtgtttatctataactaatagattttaaatttcgtaattggccagtaacgtaacttaacgaccccttggatcccgttataagctgaggcatcatcactgatgaagccgacttctttgtaacgactatccttagaaacggtccggttatcacccatgacgaagtagtgatgagctgggactttcttttgacctaagacatctttgagatcgaaagtggggccgtttgttttggggttaagtgtgaagtaatctgaaccagcgaggtaggttgaaaaatcagccttataggctttgagatatggttcgctgacttttttaccattgatgtatagctggtcgcgatcgaatcgaacggtatcgccaggcattccgacgattcgtttgatatagaattcccctttagcatcaggtgctttgagaatgacgacatcgccccgtttgagtttggcgtggcgaagcgcgataacgcgatcattttgtgtaaagttcggttgcattgaaggtccaaaaacttgttcattggaaatcacgaaggttaataataactgtgaaatacccaccatgacagcggctaataggacaatttgtaatgttgatttccaaaattcttttgctttatttgacatttaacgggccatcttatggatgctttgtcgttcttggcgatcagattgcgccgcagattgatcgttgattgactggcttgcgattaagtaaccgacacatacgattccaactaatactgcgagtagacgcgctttctttgacatatgccaacaattgaagctaattttacacccgtattactcggtagtgattttaatgtttatggaatggcacgctcattctatgaattaacaggaaaacccgtgcaagcttatgccggtgctgagcttgccccaacgcgctatacaaaaatcgtggatgttgatatcacacctggtttcagtgaagatcccgtcttcattgaaaagatgcgcgacttaattttaaaatatcaaacacacacagaaccagtgattttaattggttgtggtgatgggtacgctgaattaattgctaaacataaaacagaattagaagcagcctttgtttgtccttacatcgattatgatttattaaaacgtttgaataacaaggaaaacttctaccaagtttgcgaagaattcgacttgccttatcctaagactaagacaattacgcaacaaatggtgcttgatggtcaagtggaccaaccttttggctacccagtggcgttaaaacccgctaactctgttgaatggttagatgttcattttgaaggtcgtaaaaaagcattccggattcaatcgcaagctgaattcgatatgattattaaaaaaatctacgacaatggctacacatcagacctgattttacaagacttcatccctggggatgacagtcggatgcgcgttttaaacgcctacgttgatcaaaaccaccaagtgaagatgatgtgtttaggtcatccattattggaagatcccgcaccatcagcaatcgggaattacgtagccatcatgccagaatacaacgaaacaatctacaagcaaattcaaactttcttggaagccatcaagtttacgggttatgccaacttcgacatgaagtacgatgaacgtgaccaaacttacaagttatttgaaatcaacttacgtcaaggccgtagtagcttcttcgtcacattgaatggttacaacttggcacaatgggttgttaaggattacgtgactggcgaattgaaggaccaagcaacggtttatgctaataaagataatgatcaagcagcactttggttaggtgtttcaaagggtgtttttgaaaaatacgcgcgcgataacgaagataagacaaaggctttagccttaatcaaagcgggtcgttatggcacaactttccaatatgcaaaagataacaaccctaaacggtgggtattaacacaatggatgttacacaattatcgtaagaacttcgcacgttattttaaagaaaataaagggtgaatgaaacagttttttacagtgctcggcggcatgggaacggctgcaaccgaaagttatatcagacttcttaatcaacggacaccaacgactaaagatcaggatttcttgaactatatcgtggttaatcacgcaacaattcctgatcggtcgacgtatctaatggaccacagtcaaccaagtccagaacctgatttattggaagatattcaacaacaaagtcttttgaaaccagccttttttgtcattgcctgcaacacagcgcattatttttacgacgacttgcaagcagctgcctcagcaccgattgttcatatgcctcgggaaacggtcaagagtattcaaacaacctatccagatgctaaacgaatcggtattttgggtactaaagggactgtgactgatgggatttatgatgaagcattgttagctgaaggttatgaagtggtgaaacctagtcttgatttgcaagaacggacgatggatttgattttcaatgatatcaagggccaatcacagatgaaacctgagaaatatcatgctattttagcggagatgcaaacacaatgcgacgcgattattttgggttgtacagaattgtcactggcacaagaatgggcacctgaccatgattttccagtagttgattcacaatccgtcttagtggatcggtcgattgaattaggccttaagttacgtgaaaagtgaatggcgaatttagtaattgttagacacggcgaaagtgtcgccaatcaactgaagacctataccggttggtcggacgtggcgctcaccgctaaagggcgacaacaagcccatcaagttggccggcagataaaagacgctggctttcaatttagccacgtgcacacgtctttattgaaacgggcaattttgaccagttacattgttttagaagaactcgatcaattggcgctaccaatgactaagagttggcgcttgaatgaacgacactacggtgctttgcgtggcttgaacaaagacacgacgagaaccgtttttggtgtccaccaagtagcgcgctggcggcgcagttatacagcggtgccgccacttttaattcggtcatcaactgcgcgtcgctatcgcttagtgccacgtaagagtcgaccacgcggtgaaagtttggcgcaagccacccaacgtttattaccttattggcaagatcaagtggtgccggggttacttgctgggcaagatcagctaattgttgcgcatggctcgactttgcgtgccttaattaaggttatcgaacaaatttcagatcaggccattgatggcgtggaagtcgcaaacggcgaagcgctctattatcaatttggcacagatttaacagtactcaagaagggaagactagcactaggtagtgaaacggatgaagagaaagaaaattaaatgaagagaaagaaaattaatattgccttgacgatttgtgttttagtattaggtgtcagtctgaccttttattttagaagacaatttgttcgacaggggcaagcattggctaatacgcaaatgcaattgaagttaaccaaaaagcagttagatattcagcgtgccaaagtcaataaaaatgatattgatgatcgggtggttaatgaattaacgacgccagagcaggcatatttaaaacaagaattattagataataatttcagtggcaccattttaatcgtccgccataaccatgtcatttatcaaggtggccgtggttacgcgaatagcgaacaatttacgacgcccaaaacgacgtatcaaattggctcggtgcaaaagtcacttactgcggcactcgtgatgaaggctgttgaaaatggtcagttgaaattgacggatcatctcagtcgcttttatccacaaattcccaaagcaaaccagattacattacaaatgatgttggatatgcgttcagggctttttgaaacgagcgcgcctaaagttgttcaaaccgatgcacaacgtctccaatttgcaatcaaacatttgcaggttaaaaagattggccaacatgcctattcgccagtcaattatgtcttgttagcggggattttggagcaagccacacataaaagctacaatgatttgatgaaacaacagattattacgccgttgggggttcaggcctttaacttcatgccaaacttttcggatccacagcatgcgacagcttatgcctaccaaaaaaatggggcatacggtgcagaaattgaagacccggcctatatttatacacgggaacttgggacgggaaatctctatgcgactgctagcagcttgtatcaagtagaagaggcaattgtgcaaggtaaggtctttaagtcgaagtacttacaacaattacggcacaccaataatggccaatattcaggtggggtttataattatcgcgattatttcactagtcacggtattgaagcaggctttgaaagtcatgttcagatgtcccaaaatggtgaatcagggattattttattatccaaccaatataaatcaacaccatcgttggtcacgatgagtaagcaaatttatcaacaattactagtctaattatgcgttagttttaatcgtttgtttgaaatggcgggcgccaatcgtgaataaagtaaagccgattagacaacctacccagttgagaatgatatcgctgatagcgaaagtccctaagtaaaagacgtattgaagaatttcaattcctaaaatggtaagcaatgcgataatgttggtttcagtgaaatccgcttttaaactatagagaccgcccagtgggatgaagtagatgacatttaatagggcctccagaattgtacggcgatcatgactaataaaatcaaatggattcaggctgacagcatggtaaacactggcttttgtgaacaatacgatgaagagtagcaggagatagacgctataaatcaagtatccgtaaatcggtgaaaggcgctttaagtcccactgaatccagcctaaccagagcgcgagggtcaaaaagagaattaataggacggtcgtcttaggaaatctagccatcacacgggttaagcggggataaccccaaagtgtgggtaaaacgatgcgatgaatgaaggctctactaaagagaaaagataaaacccccgccagagaatattctaatattttacgcatttaaagtttagtatggtgtaaacgttctttgaactcagccataaagtcgaaattttgagtatctgataaggtgtgttctaatttggtaagcagctgattaagcgttgcttgttcttcacttgaaaggctgctaaataaggtttccgtaaactcgtcgcggccatcaaaggcttcttggataatcgcgcgaccggcaggggtgataaaaacgtgagttacccgcttgtcgtgttcatcggattgacgttgaatatagtctttagcagccagcttattgaggcattctgtcaacgaagagggccgaatcgccaatgtttgggcaagtgtactttgcatttgtccattttgttgatggagtaattttaaaatgcgaatttgactgacagatttatgatgcgatgaaaattgcatgccgtaataatggcgataatggtgaatgactttattaaaagtttgaaaaagatcgttgctaagtgtcgtcatttagtgagctgattttaaaaattcgagtgccgctgcataatttggttcgtcagtttgttcaacgattaattcttcgtagctaattgtgccatctgcttcgacaatcataattgaacgttgcaacgtattattgctaggaacgtataaattgagggctttaccgaagctcaaggcttcatcggagaggagttgcatcagttgaacaccttcggcggcacaccaggcttgttgttgttcaacggtattcgttgaaacggtgtagaagttgatatctgtaaattgatcaattgcttgattaaagtgttttgtttgaatgctgcaaacacgtgtattgatatctggcacaatgctaatcaatgttcgtttgcccagtaattgttgggttgtgcgtgtttgatgatctgcatcaaccaattcaaaagcgggtaattgctcaccaactttaggtggtgtcccaattgtctcgagtggttgatcatgtcttgtaatttgcatttggaaactaaaaaaattcaggcgctctatgccaaaaagatgtttaatcaaattgtcaaagaggtaaatgttaagccattggcctacgaaatcgttgacgccaacggagacgaaactgccgtcttaattggtcaggcgcaatggtcgcaaatccagcaattgttagcgattaaaaacattgatatagcagacatcgactcgtgagtgaaaaaattaggtaagttaatggtcagtgcgttagcgatgttatcaattagtgcaccaattgcgatgagcgtgggtgttgttagtgccgattcagtaacagatacaaaggctgccattacgaaaactagtactgaaaatgccgctttgttaacgaaattaaatgatgctcaaaataaagtgtcagaaatcaatagccaagtttctaacaaggtcattgccattgatgatgctaaagcaaatatcaagtcaactgatcaacaaatcgttgcacttgatcaatcaattgaaaaagctaaagctgaagtgcaagcccgtaagagcgtgatgaagaagcaagctgtttcacttcaaaaagaagcgggtaacagtgtctcagggaacgtctatgttgattttatcgtcaatagtgataacttctcagatatgatgagtcgtgcgtcagttgttggtaagttaaaccaagccagcaaagaagcgatgacagctgttagtgattcagaaagtacattggcaactttaaaaacaacacaagaaactaaaaaagcagacttggttaaaacaaaatcacaattggaagctgatcaggctaaattggtgactttaaaagatgacgctgaaaaagaacaaaagcgttttgaaacagaagttgaaggtcacaaaacacaattagctaacttacaaagccaattggattcacaaacagcagccgctgttgaagccgctaaaaaacaagcagaagcagacaaagctgctaaaactgaagcaccaaaaacggcaacaaaatcagaatcaacatcaagcgatattaagaacgaatcatcagacaatactaagacagaaccagtattaaataataatgctggtacaaaaacaccaagcaacaacaataactcagcctcaaaagcaacaacaaaaccagttgctaacacaggctcattagtgtcaaacgcactacaatttattggtacaccatatgcatggggtggggcacaacctggtggctttgactgttctggtttagtgatgtatgcagctaagatggctggtatcagcttgccacggacatcacaagcacaaagtacgcttgggacacaagtgtcattatcagaattacaacctggcgaccttgttttctggggtggcgttggttcagcacatcacgttgggatttacatcggtaacggttcatacgttcatgcaccagcacctggtcaaagcgtaacaaccatgtcaatgcaatattacaaacctgactttggtcgtcggatttagatggtagaaaaacagttattagtgattacaggcgccaccggtagtggtaaaacaacggttagtcattggttaaccgaaatgtatcagattccccaagtcgtaacccatacgacgcggcctaaacggcataacgaagtcgatagtgtggattactatttcgagactgagtcatcgcttgcacagaagcatttaatcgaatcagtgacttattcaggctatcattatggttcttcacatgaagcgcttgagctagcttgggcgaagtccccattgatcagtttagtggttgataccaaaggggcccagacttatctggaaacctttggcaaacaagtgaccgtcttatttttaacggtctcggaagcaacagctttaattagtcgcttagaaaagcgtaatgattcaccagaagcaatccaaaaacgccttgcgagtgcggaatttaaacgggatttaatggtttcaggaccgttacatgatcaagcacagattattgtgaatgatgactggcaagaaacgcaaaagacattgatgacaattattgaacagttacgtcaataattaagcaagttgttgcttgtttgcacggttaggttgtttcactttaaatgttaatttttggacagcttgttcaattgtaataccacttgcactgattttttcattgttcgttgcagttgcgataaatttttgagtttgcgtatcaagtgaaacatgataccaattattagttttgttttgtaattgcatatgagtgaaatgacgacggcgctggccgttttaaaagcaaacggatttaagatcacaaagcaacgtcgcgaaatgttgacttatttagcgcagtacgaaaatcattacatcccagtgacccaaattgacgatcatatgcgggcgattttcccagggatgagtcatgataccatttatcgcaatattaaagactttgagcagctcggtttagtcgagcaacaaactgaaggcgaacaagctcatgtgaagtatcagtgtgattttgaacatcgtcatcatcatcactttatttgccgtaactgtggcaaggtgattgagttgaagatgtgtccactggatttcttcagtgatcaactccccaactgccaagttgaaggacatcaatttgagttatacggtctttgtgaagactgtcaagaaaatgaatagatggcatttcatacgcccccaatcgtgcccccagcagcgattatttcattaattattgcaatgagcgcaacgaacgtcgttgttaatactgttaaaccagtcgctaatattaagacggagcaaaagacttcagtttcagaaagctcacaaagcagtgtaagcagtagtcaatcagcgagtcgttcagaaagcgatgagacgactagcagccaatcatctagcgaaccggaagaatcagtatcaagcagctcggaatcaacatcaacgccgtcagatcaagaacaatcaagtacagataatacgacggaaaccagctcaagcgagacgactgatacaacgcaaaacgacgagtcagctgattcaagcgatacaacaagtgatactcaaacaacaactaataacagcagtagtgcagcgtcatcaacagggacatcccaaaacgtggccaaggccactagcggtagtgcaacgcaataaatgttatcttttttggatatcattaatcattattttggctacttaaacattaataatcgggttaaaaaccgaattttttcaatcatctgtctaatcggtgatttttacttactatataagagcatctactactttagagcacaagcaattggacgaggcgtgattaatctaattgtttttttagtattactctattttgcagtgatgaatctttatttctattatcgtggtcgcaacgcggttgtcgatgtgtcaccatacgtcgaaaaggcgctgggtggcgatccaactgcgccacatcccttagctggacaaacagctaagcctaaaatcatctcacaagtccagccagcaaccggcttatttgaagagaaggatttgctaccagcacaactagaagtcgatagtgcgcatcaacaacaactcgaccaattagtcgcacaattaattgaagctggctatatcagcttaaattacgctgggttggcagatgccgatatttacgagcaagcacaacatttccaacgcccaatttatgcaattggtgaacgagtggccttgccgttttatgagcttaaacaagaagacggtcagtgggtggtttatggtggcattaacgcgatggccaaggcaccacttgctgttatcaaatcagtggggctcacaccaatccaggaattaaccgatcgttatcaattagcgattgcccacacgtggattactggtggaccacataagatggccggccgtagtggggttgttgaaggcagtgatccttatcaattaatggttcaaatggcctatcaaaaaagagcttaagtggaaatccataatgaatttctagatttgaattatcgttatcaatattatttattagaattagtcgctgatcatggggattactatctaacagtaaatcgtgcgatgaaattattgggcttatctaagttcaaactgagtcaatatgttgagacggttaatgcggatttagcgatgatgagccctgagagttatttgagaattaatggggatggcatctttgaaagtggccatatcagtgaatcaatcgtccgtaaaattcgactagactacttacaacaatccaatttattcaagatgtttgaatttagtttattgaatccaggtaaaaacgaaacgactgacttttgcgatgctttattcattgggaaaactaagttctatgaattgcggaaggaaatggtagaagggtagttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagtcgaacgcccatttggatattggacagccctagttcacaaaaggtttcgattttaattcgttcggaataggttatactagacaaatgcagattcgccagtttgtttttgaaatctattatagttactttaatggcattgaaaaaccattggcgttattccaagaaactgtcgaccagatgttagtgacgatgcgcgatcagtttcagattaatctactaccaacgacaattacaaagttggagacttatctcaaggtacaatcattgcgattacggggaaaaaacgcgttaactgcccccttattagcgcctgattttaagacgcaacaaccgcaactatggcagccggtattgagcatgctgacgactaactatcagttattacgaattccgctagaagtggaagcggaaggtctactgacgtttttatttaccgaaagttatgtaccacttgaaattgactatttaacaccggaccttaaaaatggtgtgtcgcaaaagaccggccaatttgttagcaaagttgagcacgtcttgatgaaagatgaagcgcatagtgaacaagctcaaaatattctggctaacttagcgcatgatttagatcaaattcatgcaaagcatttaactttttacacagaaccaacaacctttattgatgaacaacaattgacctattttgcagaagcaaatccactatttcatcaaattattttgacgtttacgaccaaacaagaaacggatttggattggcgtaaacaggcgagtttgtattatgattacatgtttgcctgtattgaagatattccgctcgaaatattaaaagatcgtgtttatatttgtgtggatttctcacaaggtagactctataatcagtatatgaagaaaacagtcaactactttaacaatctgaatatcgaagtgcaaacgaccgttgatgaacggacggacctctacctatctgatttttactcaagcacgttgacctgtgaacaattaatttggaagaatccgcctactattttgaactggcagcaatttggggatttagtggtcgcgattaaaaaggggaaactatgaatgaaatcaggcaagcagattctcgccttaacaattcttagtttaggcgtttatcgtttttcacaaacttttttgatgcaacaagttcaaaaagtatcagcagcagataccgctgttggaaaagaaaattcagatgctttaacgggtaatgaattgaatattacggttaaaaactatccgacaaaggtgattgagtcatcatcagactcacagtcttcaagttcgtctgcccaaacagagcagccagtttcaaagacgcaacctgatcaacaaacgactaatcaatcgacaacaacggcccaacaagttcctgcagcacagcaggatcaatctaagacagcaaatacgcaagaagtagcagagcaacaacgtgcagctcaaaaagcgactaatgcaagcgataaatcaacagcggcgcaatccgttgcgcaaacgacccaggatcaagctaaagctgctgaggcaacaaccgctaatacagctaaaaatacccataaaatcgcaaaaaaaacgattaagaaacatgctaatgcaagcatccaagaacatggaaatcaacaagggcaagacaatgcaaatcaagatcaacaacaagcagattttttgaagcatcacgctcaagttgaaaaagatatcgcgatgttccaacaaagtatgagccctaatacaccatctggcggcgcaacaactcaagtcggggcggtctttggtgcactagcaggacaaggggtatacgctgttcaaaatgaaattgaatgattgaagcaacagcattattttcggaaactaacggttattctgacggttgttagcctaatgctgagcctttttgatatatccgcattagcagcggcaaccgatactaagaagcaatcaccaattgaatcttttgtaattcgtgggcttgatgataatgaacaagctgttcccaatgctaaaatcaatttaaaatcagagaatggtaaatacgactatacgttaagttcagataatcgtggttttttcaaaacagtcgttgagacactaacagggcataccgttcgtggcatcatgcctgggaaatatcacgttagctcaattgctgcaccaactgggtatcaattggaaaaatctaatgaactaattgaaattgctgcggatcaagctaatttctatcacttatactacactgatgcgagtcaaggcgacttagttgttaagacgcaattacaagacggcacaccggtgtctggtgttgttttaatggcggttaatcaaaaaacaaatgaaagttacacggcaccagcaagtgatgacaagggttggactaagttgacattaccaacgggacgttatcaattgaaagtgattttccacccagatagtagtgaaccacagtgggcaccgactgtcacggttagcgctaatcaatcgttgacgacgacggttgattttggcaagaccaaaggtgagatgatgacaacagttacggaccaaacaactggtgatccgcttgtcggtgtttagatgttgaagattaccagtctttcagaatccggaatagctttaccacatgtgagctatcgtgttacaacgatggctaatgaacaataccgaaccgttcaaactgatgataacgggcaggtaacagttgggcaattacccgcggggcgttatcagattcgagaagttgcagtaccggatggctatcaattggctaacatttcccaggaaataaccctcgatcaggaaacaacagctgtttcgtttgttcattagttgaatgcgtctaatgcgcaaggaaaagcgctggctggcgttcaactaaagctcaaactggtgggttctaaagaaagttatgagcgaacagttacgacaacggcaacaggtaaagctactttggcagctgtcccagtaggcgactatcaagtgacgcaagaatcaacggtgatgggttatcagccagccactgctgttcagtcattaacaattagtaacgaccatcagaataccgtagattggcaattgcaacgaatggtagcggatgttacttttagagttcgcgatgccgcaacgcatcaaccgctagccaaagctgcttttactttaacgacagcaacgccggctgataacggtcaaactgtttttgtttcgcaaaagacgaatcaagatggtgaagtgaccattaagcaattaccaacaggcaaaataacttacgagcaaatggccaatgctgcgggctacgagccactagcagcgattcaaacggcgattgtgggtgctgatggggcacaaaacactgaagtaacagttgataatcagcggctaaaagtgactgaaaaacagcaaattatcgtgcataaaaccaatcaacaagggcaagggttagacgatgcggcctttaaattaactaatctggcaactgggcagacacaaacgcaaaagacggtgtccgggcaactacactttactgagttgaacccaggacggtatgagattcaggaaacaaaagcaccaactggctatcagttggatcaaacacctcagtttgtgacgattaaagtccatgaaaaacggttataccaagtccgctttgctgataaacgtgaagtgactgcgccaatcagtccattgcgcatccagattttagataatcacttgcaaggcgttgctggtgttttactgcgactaaccgccgatcaaccggatgaccaaggtcagaccgtttgggaattgacaactgatcgattcggacaggctatactccccaatgcaagtacggggcactatcgggttgaggttttacaagtaccgaccgggtatcaattgtcgtttgatcaaagtcaattagatgtcagccgctatggtgaaaatcagttacaattacaagctaatcgaattgagatgccattgcaaaccttaacgattaataaaaccaacttaaaagggcaacctttatcaggtgctgtctttaaagtcgagtcactgaaaactggtcagatgactaaagttgaaacggatcaaaccggtcgggctgagttgcgggaccaaaaaccagggcgctatcgcgtaactgaagtggaagcaccacttggttaccggttagcaactgaacctagaattgtagcgttgtctgaaaaatcaccgcgagcaacacaactaacggtaacagatgaagcacaaatggggcagttactgattaagcatacaactaaaaagggcgcaccgattgcaaaggcctactttgaggttaaggatcaaagtggtcgagaagtcggttattatcaaactgatagtcaaggacagattaaattaacccagctagcagtggggcaatatactgttcaagaaatcaaggcaccaactgggtatgaaattaatccggcagtgacaaaggtggccattacggatcgcaaaacggcaacggtcgccattaaggctgagcaacaagcacccgatgttaaattggggagttttgtattgatcgatagggatcagaaaacgcagttagcgattgctggtgcaacttatcgattggaaacgttagctggtcaggcggttcggccaaaaattgtagtgggtgcaactggtcaagtcgtagttaacgacctcacacctggtcaatatcgactcgtacaattgacggcggcacctagctatcaaaaacaaactaacgatcaaatcatcgagattaaacaggatgcgcaacttaaacaagtgacgattgaaagtcatcagtcacaagggacagtcattgtaaatcaagtagatggcaatacgaaccaagctttggttggagcgaaatatgaattacaaaatcaaagtggtaaagtgcttgtcgaaaacttgaagagcgatgaacatggtcaagttcgcatcacacatctcgatcctgatacgtaccgtttggtgcaagtatcggcaactaagggctatgacccgcttaaaaagccgattgtctttacgataaccaatcgctaaatgtcagtatattacctaaatagaaaagatcctgtaagcgaaatgattaaaacggttcaagccggtatggcaagtcttagttattttgaccacctagaagaaatttgccgtgacgttaatatcagtttagacgatgctatcttattacaacggattaatgagatgacaacgggtcgatatgttgatgcacaaattgtattcagtgcgggattggttgaagaagacctctatcgtttaaaggatgctggctggctcttagggatgcgcgatagcgaacggacaaaacaatacgtgatgttaagtccacgtgcgcaaaaggccttagaagcgatttcaagtgcctatgaacaggatggcccagtaatcgcccctaaaattgattcggctgatgtgcaacggattatgcaagcagcggataaagtttttcaaaaatatcaataattattcttgaacatatttttgaacggcacctagtaaatcagggctgatttgtgcccgaattttagtcccttcttcttcataactttgttccagaatgttggcgcgttcgcttaagtaagcaaccgcttggccttctgtaaacggaatgagaaaatcaagagttggatattgttcaaagagttgcttgttgatgagcgcgattaaagcatcaatagcaacctcatcacgtgcagagtaaacgatttgtgtgccatcgacttctgggtagcgggtatcaggttttaaatcagctttattgtaagcttcaatgaccggaatatccttaacacctaatgagtcgagcgtttcttgtgttgttttcatcatatcgaggtaattaggatctgaataatcgacaacgtgaatcaatagatcagcatccgcggcttcagccaaggttgatttgaaagcctggatcaagtgatgaggtaatttagtaacgaaaccaaccgtatcacttaataagaatttctgcttgttaggaagaacaatttcgcgaacacttgtatcaagggttgcaaataacatgtccttttcaaaaacttgtttttcaggtgtgtctggattcaaacgttgtaaaatacggttcatcgttgttgatttaccagcattggtataaccaacgagtgccacaacagggaccgcatttttagtccgttgacgacgttggacttcttgttgttgatcaatttgggctaattcaccctttaatttagtaatccgtttttcaattaaacgacgatctaattcaagttgtgtttcaccggccccacggttagttgaaccaccgccaccttgctgatccagtttgttttctgaagggtgtagacgtggcaattggtattttgcttcggcaatcgcaacttgtagttgggcttccttagtcttggcgcggctcgcaaagatttctagaatcaattgtgtgcgatccagaatactcatttctaattctttttcaaggtttctaatttgtgaaggggatagttcatcgttaacgacaatgatatcagcatcggcttgagcagcttcagccttgatttcttggactttacccttaccaaaataagttcggtgactagcttgatcgatgttttggcgtacttcaccaaccacttctaagttatcagcgcgggctaattcgcctaattcacgcattgtatagtcaaagtttgtttggcgattgctaacgccagtaattaatactcgtttttgtgccatttttgtttcttgcatttattcagcgtcatatgccttttggaaaagggcaacgatttctgctttagttgccttacgtgggtttgaaaaggcgttgccgtctttcaaagcattttcggccatcatttcgaaatcggctggtttagcaccgattgctttgatgctagttggaataccaacatcggctgccatttggcgcatccctttgatagcaagttcagcggcatctcttgttgaaagagcatccgtattttcgcccatcgtgcgtgctaactctgcaaaacggtcgggacaagcgacgatgttgaattcttcaacgattggtaataagagggcacaacaaacaccatgaggggcatcatattggccacctaattgatgggccattgcgtgtacgtaaccaagatcagcgttattgaaagccataccggctaacatttcagcttcgcacatcttggtccgcgcttcgatgttatggccgttagcaacagcttcgcgcaagctttcttcaatcaacttgatggcttggagacattggccatcagtaatcgcattacggttggttgaaacatagggttcgatggcttggacaaaggcgtccatcccggttgcagccgttaatttagcgggaacatctaacattaacattggatcgttaaatgaaacgagcggaatattccgccaagaaacgacgacaaatttaagatgggtttcttcatttgtaataacgcagtggcgggttaattctgaacctgttccggcagttgtattaaccgctaatagtggtggtagggcgttttctaaggtttcaatcccagctaatttggtaatgtcgtcaccgttagtgagcaagataccaattcctttaccacaatcgtgagcggaaccgcccccgacagtaatgaggccatcacaaccatcagcgaggtattgcgtcttgccggcttgaatattgcggactttaggattaggttcaacaccgttaaagatgctatattgaacaccggcttgatccaatgaagcgagtgtttgggcgacaggaccatcaggaacaccttctaaaaaagtatcagtcacgattaaaggtttggtaatatttaacattttggtgcgatcaccaatcttttcgatgacgccagggccaaaaaagttaacgctaggcattaaaaaatcaaagtttgttttcatatggctaatttagcgctgattgatgttgggggaacaaccattaaatttgccttatgggatggtactgctcataagttaacaaagcagggaatggttgcgacccctaaatcgctaaatgcttattatgcagcgttgaccaaaattgttcggacatatcaattgtcagatcaaatcgtcggcgtgggaatgagcacacccggggcagtcaataaagcgactgggattattgaaggtgccagtgccctcccgtacattcataattttgaaattcaaagtgcattagaaatgcgatttggattacccgtcattatggaaaatgagattaattgtgcagccttggccgaattaggcagtggttcagcagagggcttacagaacgttttatatttggcgattgactcagatgttgggggtgcggtcattattgatggacacattcaacatggctcgcatctgtttagtggtgaatttggtgcgatgttaatgtctgatggtcatccgctaagtgaggtgggaaccattacttatttaacgcaacaatataatcaacaagcccatgctgaactgacgggaacggaaatttttgctttggcgagacaagacaattctttggcacaccaagtgactacggccttttatcaacatttagcgcaagctatttataatttacaatattgttttgatccggaagccattattttaggaggcggtcttgaaaagattgattttttagtcccccatattgaaattgaacgtcgcaaattattaacgcaagttcagctggcgccatttgagacaccacttttagcgagtcagtatcaagacgatgctaacctaatgggagcattggttgattttcaacagtgttacccgcagaaaatgctttaagtgactgatatcaaaacgcaaacaccacctcaagaattaaatcgaacagtcggctttacggccgccttatcaacagtaatggggactgttatcggcgcaggcgtcttttttaaagcatcatcagtaacagaagtcacaggttcaacggggctaacaatgttggcctggttgcttggtggtatcatcacgatttgtgcgggcttaacggctgctgaactggcagctgcgattccagaaaccggcggtatgatgcgctatattgagaaaacttatggcagtgtcgcagccttcctactaggttgggcgcaaacaacggtttatttcccggccaatattgctgcattatcaattatttttgcgacacaatgtttgaatttatttggatgggcgcctagctggcaaattccggttgcagtcattgtcgcaacgagtttaacaattatgaacttctttggaagtcgtgtgggtggctttgtccaatcctttacgactgtctttaaattaattcctttagctattattattatttttgggttaattaacccgggtactaacgcaagtcacgtttcactctttactgtagcaggaacgggtacatcgaataatgtcttatcagcattgggtaatggggtattagcaacgttatttgcctatgatggctggattcatgttgggaatattgccggggaaatgcgccatcctgaaaaggatttaccaaaatcaattttgttaggtctttttggaacaatggtggtttacctcttagttaacgcagtcttcctactagtcttaccaatctcacagattgctggtaacgaaaatgccgctgccgaagtagctggtcatttattcggcggttttggtggcaagctagtaaccatcgggatcttagtttcagtttatggtgcaattaacggttatacaatgaccgggatgcgcgtaccatatgcgatggcaactgaacaacacttaccatttagcaaacaacttagccgcttatcaaaagctggcattccaattttatgcgggattttacaattagtgattgcgatcggtatgatttttgtgggtggttttaacacattgaccgatatgttaatcttcgtcatctggatattctatgtgatgacctttgccgcagtgattatcttgcgtaaacgcgaaccagaaatgaaacggccttacaaagcagttttatatccagtagtcccattaatcgcgattttagggggaacgtttattgtgattaacaccttattcacgcaaacgatcttagccttaatcgggttgggaatcacattgattggcttaccaatctattactacttagaaaagaaatatcatcaagcttaattaagctgttttttttcgttgatacttagcgattaatgggaggatgacccctaagcccattaatgaaacggaaaccacgacgtttaagatcaattcgtgggtgtatttagaagtgcctggtgtggcatcctgtgggaagatactgaagattgtccctaatgcggtgataagcaagcaccagaaaccaacaataatcgcccaaggtttgtttttaatgtacgtatattctgatgggtatttgtcgctgttgaagcggacccgtaagaaggcgacaaagatgaagcaagtaacaaatggtgagacgatgccgttgatattcaacaaccaattaaagatatcgttgatggcgggtaagaaggcacttgaagccagcacgaaagtacagatcccagtggttaaccagtaaccgttgattggtaagccttgtttgttagtctttgtgagggccttaggtaagaacttcttagcagtatcagataagaagattcgggtcccaccatcgagtaacatagcgagttgcgcgcccatgtagatggcttgtgtaacggcgaagatgtagagcaagactttgcccatatggaattgttgacctagcgctaagaacgcgtagtaagaaccgttcatttttaaatcattaggtaagtggttggcatcaaagaaaacaccaatcgcaaatgaaccaaagattgttaagaaggctgtcattaaagcgagggccatcatggctttaggaaaatcttttttgccatctttcatttcgctgacatatggtgcgactaattcggcaccgttcatggcgaaaattaaaaggccgatggttgagaagtaatgtaaatcgaatttaggaataaaagtatgccagttcattggttgtgtggcgataggggcgccgttaaataggccggcaaatgtcatgagaacgaataaaatcgtcataataaacattgcgccacccccaacaatactgaggacttgcagtgacgctgtaaatttatgttggaagaagatgaataaaatagtgatagcggctgttaagagcgcaaatgtcgcccgtgacaacttatcttcaatattaccgttccccatgataatccagaagaaggaaacgaccattgagttggcaacatcgactaagtaaggcaaactggcaacccagtaacaccaagcagtgaggtaaccccaaacatccccactggtatggcgcatccaactggataaaccaccgccatctttactgaaagctgagcctaagtggccaaccattaattcataaggtaagacataagcgaataatagcacgatccatgagaagacaaccgccatcccttggttttgaaagttataaataatatcatcgaagccaattaccgtgacaaaatccattaaagcgaggacttgccaggtaatgtatttcttttttggttcaatttcatccatatggatacaccaacagttgttagcgtaaaagatgtacaaaaaacgtacggtaaagctaacgaaaaacaatatacagctttaaaaggcgtgacctttgatgtgcaacgtggcgaattcgtcggcattatgggtgcttctggttcagggaaaacaacgcttttaaatatcctatcaactttagataaaccaaccgccggtgaagtgaagattaacgatcaagaaattagccgcttaaaaggcaatgcattagctgactttagagctcaagaaatcggctttatgttccaagattttaacttacttgaaaatttaacagcttacgaaaatatggcattaccattaacgctccaaaacgtgactggtgaaaaggtccgcgaaaaaattacaacaattgccaaaacgttatcaattgatgcgattttgaataagtacccaaccgaattatcaggtggacaaaagcaacgagtggctgctgcccgggctttagtgcataatccagccattctttttggggacgaaccaactggtgcgcttgattctaagagcgcccgtgaattattggatacaatggcccaattaaacgaagaacaacgcgtttcaatcttattggtgactcatgatccattctcagcaagttattgccaacggattctcttcatcaaagacggtcaaattggacaagaattagtgcgtggtgacaaaacacgtgaagccttttaccaagaagttttagatacattaggaacatttaatcactagatgctatggaaattatcattaaccggcattaaaggccggtttaaagactatttagtccttttttcgggcctaattatgtcgagtgccattttttacatgttcgaagcattagcgactaataaggattttgtgacgagtaattccccaattggcatggcagcgattgtcttccaaattggttccgtcttactcggcattatcacactggtctacattatctacgccaatagtttcttgatgagtatgcggcgccgtgattacgggatgttcatgatgttgggtgccaaagggcgcaagattgcccaattgattgcagctgaaacgctcgtcattgggacggctgccacgttaattgggacggcgattgggattgggttaacgcaagttgtgagccaattcttactttctcgattagacatgcatatcaagcatttctcaccactctacttaccagcggtgattaccaccttgattttattcatcgttttattcatcattgcggcggttgttaaccaatatcaattattgaaaacacctgtcttacaattactccatgatgatcaacaaccaaaccgcattaaggaaaataaagttacgcgcttaattcaaatcgttttaggcctcgtattcttagcagttggttattacatgatgattgcaatcgcaaaattccaaattatgggattagtgattgcactgatcacgattgtattaggtacgtacttcctatttaacgcctttttcggttggttattgatgctcttaaaacgcaatgaaaagttgcggaataagggtttaaataacttcacgttagcgcaattgagtttccgaattaaggattacacaaaaatgttggctttagtggcaatgctttttgcacttgcattaggggcgattacggtcggaattggttatcaaaatgaaattcccaagattgctgactcggcatctgcctatgatgtggtcttaaatcaaccaacacaaaaggctttgacgctgactaaaaatctcaaggggattaaacaaacggcgacgtatcaagtgaaagaagatggcaaaaccgtttattaccgaacagagcagtttaaacaaacgccgctattaactatcgaatacggtaagacaggtagtgtttcttctgaaacgaaggtccgcaaagtgccattgagcgaacttcaaacaggggatacctatctcttcagatcaattcaagtaccaagtcaaacggctaaagcagttaaactcatttctaatgaggcctttgcacaaattgtagcaccaaccaaggttgttaaaacctacgatgtgcaagactttagcgctaacttacctgtcattaagaagttatatcaagaacaactcaaagccaatccagagttgaaggctaacccagaagctgatagtagtaagtatgtcagctataagatggctaacggcgttttcagtggccttgaattcatgggcttcttcttagggattgctttcttagcaatgttagctagttgcctaatgttcaaaattttatcgggtgcggctagtgacgtgaaacgctatacgatgttggctaaaattggcgttcgtcaaagcctcttgaagcaatcaattgccaaagaaatcggcgcattattcctattaccagggattgttggtgtcgtgcacgtcttgttcggcttacaaatgttcaaagaattaatgatcgatccatataatcaaatttggattccgttcggtattttcatcgtgttatatgccgtgtactatgtggtgacaacgtggctatatcgcggaattgttttaaaagaaactaaatttggggaataaatgcaattattagatgatgattttctcttagacaatgacatggccaagatgttataccacgattatgcagcgcaaatgccgattattgactttcactgccatttgaacccttcagaaatctatcaaaataagaactataccaacatcactcgcatctggttgaacgaagggacgtacggcgatcactacaagtggcgtttaatgcgtgccaacggtgttgatgaaaaatatatcaccggtgatggcgatgattatttaaaatttatcgaatgggctaagacaatcgaaaatgcctacggtaatccactttacgaatggacgcatttggaattacgccgctttttccacatcgatgaacgtttaacagcggaatcagcaccccgtatctgggaaaaggctaaccaactcttacaaacagacgacttcaaaccacgtcaattgataaaaaattcaaatgtacaagtggtctgcacaactgatgatcctgcttctgacttacactaccatcagttattaaaaccggaagaagctgccaacggctttaagacgttaccagcaatgcgccctgatcaattgatgcaaattgatcgtgacggttttggtgattatttgaagacccttggaaaagtagctggggttgagattcatgattttgcaacgattgtaacagctttgacgcaacggttcgaatttttcaacgaaatgggcgggcgcttatcggatcattcgctattgacttaccattttgaagaagcgactcaagcggaattggatgcgattgttgctaaagggattaataacgctgcactcagtgaacacgaaattaaccaatatttgacgatgttgttagaagcattgatgaaactcaatacgcaattcaactggacgatgcaattccatatcaattctgatcgtgatttaaaccgcccaatgttcgctaaaattggtcctgacacgggttatgatgctgtcgggacacaacctgacattgttaaacatatcagcgcactctacacgaagatgcaacaaactgaagacgtgcctaagtcaattttctactcactaaacagtaatgattggttagaattggcaaccatgatgggctgtttccaaggtgggacaacgcaaaaattacaattgggtgccggctggtggttcaatgataccgccgaaggaatgacccaacagttacaagtcttcgcacaacagagcctcctaccacactttgttgggatgttgacggattcccggagtttcctatcatatccacgccacgaatacttcagacgtgttttatgtagcttctatggccgcttggtagaacaaggtcgtgtgccaaacgatgctgcagaattagggcgtgttgttcaaaatattgcctataataatgcgcacgattatttcgactttttttaaatgaattatcgcggcttcttttttatattcagcgtgcgcaatgatttctggtacaatgttctaagagcgtacagaaaggaagcatgcggcgtgaaaaaggctgataagacaaccgtcacgattcgaacgattgcacaacttgcaaacgtctcgcatatgacggtttcacgagcactgaatgatagtgagctggtaaaaccagccacgaaggagaaaattttagcgatcgccaaggagatcggctatgtgcctaatattaacgcgaagagtctagtgacaaatcggtcttatatgattgggattttctttaccaaccttgaaacagggacttctaatagctttatgacggatgttgtggcccaagcgcaagcggtattgcccaagagttattcgctttcgattaatagtgtcgccaaagcgatggcagggcagtatatttcaattaataactacgacgggattatcgttattagtcagtctaaatctgattatgattttattgaatatgtgcataatctgggtttaccgttagttgttttgaacagggtgattgagcggaatgatattaataattatgcgattggcgatcgattaggtggggagttggccactaattatgcgattcaaatgggccaccgtaagctagcgttgatccggggcgttgattcgttcgaatcatccgtccagcggactaatgggttcatgcaagctgttgaggcgaatggcattgcagttgacccgacactaattaaagtcggcgattaccgaccagagagtggccatgaattgatgcgggagattctggcgagtggtaatattccgtcctgtgttatttgtgagaatgatgatatggcggttggtgcgattagcgcctgtgttgaacttggttatcagattccacgcgatatctcatttatcgggtttgatgatatggcatatgccaaatttattacgccgtcattgacgacaattaaaaaaccgactgcccaaatcatcgaaatgggtgtcgctaaattaatggcgattgttgaaggcgagcaatcagacgttgaacaaaaaattgttgatccagaaatggtcatcagacaatcagtcgttaatttatatcaacactaaatgaaagttgttcaggattatctgacttcctccataggatacagattaattgctaggaaatacggtattaaaagttcttcatctgttcttttttggattcgacgttatgagacctttggtctaaaggggctcgatgtcctatcacctgataaaatatttgatggctcatttaagatgaatgttttaaaatggatgaaaacgaataaggcttcttatccgaaaaccgcacttcattttaatatctcaaacgtcgggaccatctggcaatggcaacatatttgggagactgagggtgctgatgccttatatcgttccaaaggacggcaaacaattatgacagctgataaacaatcgaaaaaacggcagcaaacagaactagaacgtctgagagaagaaaatgaattactacaaatcgagaatgaatacctaaaaaaattaagagccttagttcaggaagaagaagacaacaagcgcaagtcatccaagagctaaatggctaaaagtacgtatgaatacattattagccatgaaccgaacggttcatctgaccaatctgttaaacaagccatccaaacaatcaagaagaatcatccagcgtacggttatcgtcgtgtaactggtgaattacatcgtatgaatatcttagtaaatcataaaaaagtgcttgtcttaatgcgagaactacaattactatcaactgcatttaacaaacgtactcgtaagtataattcatatagaggtaatgttgggaccgttgctaagaacttaatccaccgtcgtttcttcactgatcgtccctatcaaaaactagtgacagatgttactgaagttcgctggggaaccaagacaattgacgaacgtgcctatttcacatgtatttatgatttattctcaggtgaaattcttagccatcaagttagcagacaccctactgttgaatttacaacaactgttttaaatcgagcagttaagaaaatccctaagaatttaaaataccggacaacagtccactcagatcaagggtttcaataccagcatcaagattggactaatatcttgaaagaacatcgcatttttcaaagtatgtctcgaaaagcaacatgtttagataatgcatcaatggagagctttttccatattatgaaagccgaagctttctaccaaaaagaaaccgatacttatgaaacgctagtttcacaaatatcggtttggattgatgattataatttttcaagaattaaaacaaaactgggttgtaaaagtccggttgaataccgaatttttacaacccagaaagctgcttaattaaagggttaattcattataactttgaacagtgacgccttcatcagtgaggaccacttttgtgatactaccgttcatcgggctcaccgttacgtcaaattgaccattgccaaatttgccgacgatactgcgaattgttgtcccatggctaaccatcaagacgttgtcgccgtcggaacattctgaacgaatttgcttgaagcctttaccaacgcgggcccaatattcagccgcattttcagcatcgttaaaaggatcagcttctttcatgaaatcttttgaagcatcgagtgagtacttcgtaatgatttccttgaaagttttagcgtcgtggctagcgccagtcatgtaccaagctttcgctgaatcttcaccttcatagtaaccgtagaattcttcgcggaaatgaggggtgattgtatagggtgtgtcgaggtagaaactctttttaagaataatcttagccgtatccatcgcgcgactgcgatcacttgagtaagcctgggcgaagttaacctttgaaagttgtttgccggctagttcagcgtctgcgatgcctttttcggtaaggggtgaatcggaccagccttgcatccggttgtagcggttgaagaaagtttgtccgtgacgaactaagtagagtgtaatgcgtttcatatggcaaacaaagtaagcactgcaatcagtgtagatcagtttaatgaatggtaccttaaaattggtcaaatctatcataaaattaatcatattacggtaagccatgatcttagttacgaccaatatttgattatgcgagaactaaagcgaatccctagtattgaagtgacaaagctgtcccggatgtttgatattacgagtccggcgatttcgcgcaaggtcaatgtcctctataaaaagaaattgattactaaaaagcggagcgatattgaagatcaacggaaagtttttatttgtctaacaccattaggtgaacagttaattgaagagctggaagatgattttgaagctttatttaaagaaatgattggcgaaattaatcaggaactaatgccgcttttcaaaagtacggattgtttttataactacctttcaaaaaaagcacagcaacaagcctaactagtctttgaagttgccactttctacgtccttgatgaatgtcttcaagtggtcgaagtatactggggcgttatcaatcatatgatgatgaccaccatttggtgttgtcaccaaacgtgaatgtggaatcttttcagccatgatcttagcggttgcgattggcattgtttcgtgttcgccaaatgtgattaatgttgggacagtaatcttgtggagttggtcacggaagtgccagtccttcaatttaccagtcacaacgaattcgttgtcgccttggaagacgccataaacgtctgttgccattgttgggattaaatgtgagatagctaatggttgtttgcgatcaacgtaaccagcgtttaacttgtcaacaagtgcttggtattcgtcgttatcgtaatcgtttttagcttcacagtcttgcatgaattttaattgttcaggcgtcatgatgtcttcgcgaattttgttgatgttggttacatattcgtcgatttcatcaaccatgcttgaaatgatggcacccttcaagtgttggccgtatttagcagcgtacatttgaactaatgcgccaccccatgattggccgattaagtagaagttgtcgatgccgagtttttgacggacttcttcaacttcgtctaggaagtagtcgtaagttaataattggtcattgcctggttttgagtaatcaggttgatcagaataaaatgaaccaagttggtcgtacatgtgtacttgcacaccaagatcagctaattccttaccgaagttttcccagtattcgtgattgccaccagggcccccgtgtaagcaaagtaagtgaatatcgcctgttccttgcgtgttcgtccacaaatgataaccattatccaatgtgaggatcgttgttccttgtttcatttagttgcgggtttctaattgctgtctaatcgctggtacagcttttttgttaccggttaatatcaagtgatcgttcaagtgaatttgcgtgtcaccatgtggcataatcagttcctgattgcggtaaattcggctaatggtaacttggtccacaaatggcaagttggaaatctgtaagccggtgaagcgtcggttttgaacggtcacttcgaagaggccggcatcggtattatcgatgatttgaagggtcgagggggtttcaatcaggcttcggagtaagctgatattggcttcgtaagtattgaagacttcaacaccttgttccttaagttgatcgtatttttcatctaagatatcctttgcttcaaatcgggcgataatccggggcaccttagcgtcaagtgctagttgggcgaggcgataattttgttcgtggttcagataaccgaggatgataatatcggcatcaaaagcaccggatgtcacaaggctgtcttcactgagatctggtagtaaggtcaggtcagcggcactgtggtagatttcgtaattaccttggttatcagtgaagagttgtgtggtataaagcccgtttgatagttgttgggcaatgggaatcgtcataatgttggcgccgataaacttaacgcgtttgcgcggtaaatcttcaggagttggctgatagaagcgattgaataggattggaccgaggatacaacttaaaatggcagccaaggtgaaggccccggattgttgttcggtaatggtttttaagtttagacccaccgttaaaatgggtaagaccaacgtaattgttgtcgcacttaaaaaagtacccgcaatcgtattagtttgtttaaagcgccgttttaaaacccaataggtagctgctttggagagcataaaaccgatgaagaaaaagggaattaacgacaacgatttacgatccgctaagagtgctggcaggtccaatttagcacccgtcatgatgaaaaagattgggatgaaaaagccgtaaccgatggaggttaacttatcggttgtttcttcgcgtggccgtaataatttcatgaccattccggctaagaaggcccctaaaatactttcggcgccgacttcttcagcaattgacacgagtgtaatgattaagaagaaagccaaacggatgtcgagttgcgtggtggatttatcaatccgggcgaagaaatgatagacgcctttgaagcggactaacaaataaatcgcagcaacgaaaattaatgataggagccagagacttttcgaaccggggttattgagggatgaataaaccgtcaatgcgaccaacggaataatttcgcccaacaccgcaatcaagagaatcgtttgaccgagtggttggctaagcagttctttttccttgagcgcagcaattacgacaccgagggcaatcgttgaaaagaggatggttgccagcccaatatctttgaagaggccactccaagcgagtaaaccacttaagccaaatgaaatcagtaagataaaggcaaaactggtaatcgctaatctgacaggactcggttgaacttttagttggggatcagttggtgtgggttgttttttaaagaggtcaaaatcgatttccatcccacttaagaaaatcaaaacggtcacgcccagcgttgagagttccgttaaagtcggggtggagacgattaaatggaagccactcgtccctaaaataatgccgacgataatttcggcgacggtggtgggcagataggacattttaaatttagccatcagaagcggcgtcattaaagccgctaataaaacgatgacaagtgcaaggttagtcatatgaaaataaaagagagtttagccgttggcagctttgcttttttcggtggtatcttgcgttatttaatcggattggtattgaatcagccaactgggtttccgtatgggactttgtgcgtcaatttaattggggcgttttgcctaccatttttgatgcgctatatcgtggcacgcttacatttgagtgaccaattagccttggcaattgggactggctttttcggtgctttcacaacgttttcgagctttagtgttgatgccattcgattggtaaatcagcaacaatggtcagcctttgcttggtatgtcgggatcagcatggtcgggggcgtcttgttgagtttactagcggattactgggcggttaaattgacacacggccctgaagaacaggaggtctcacaatgaatgactattttattagttggtttgggggcagcgttgggggccattttgcggtatcaattgacgcgaattgggaatcacgtcgctagtgaattcccactgatgacctttttaatcaatctaaccgggagcttttgtttgggctggttgaccgcatctcaattaagtcagccggtgacgctctttttaggcgtcggtgtgcttggcgggtatacgaccttttcaaccttaaatagtgagttgagccaattgtggtttcggcgccggtatcacatcttctttggttactggcttttaacctatggattgggtctgttggtggccgcagccggcttttatgctggtttatagttgactgacgtacagaaatcattggaacaaagccgattaacagaaattattggtttaattaaaaaagctgagacccattttgaaggggctgttaagcgcgcaaaatcggaagaaaaagaaattaacgagaacttcttcaacgatgttcgccttaacttcaacaacgattccgcgatgactgaaaccgccgtttcgattgaacagcagcggcaaatgctacaagaacgcaatcactcgtggcaacaatcttcacggcaattggaaaccttgcaaaagatggaaaagacgccatactttgcccgtgttgattttcaagaaaagggtgaacctaaatccgaatcaatttatatcgggttaggctcatttacagataccgacgatcatttcttaatttatgattggcgggcaccaatttcatcaatttactatgaaggtaagacgggtgcggtgacgtaccaaacaccagacggcccgcaagatgtgaatatctcacttaaacgccaattcttaattgaagatggccaaatcaaggccttatttgatacgcaagaaacgattggcgatcaaatgttattagaagtgttaggtgaaaaatccgatacgcagatgaagagtatcgtcacgacgattcaacgtgaacaaaatcagattatccgtaataccgatgctgatttgttattcgttcaaggggcagctggctcagggaaaacatcagctatcttgcaacgcattgcgtttttactctatcgctatcgggggaatttagattcgagccaagtgatcatgttctcgcctaaccaattattcaacgactacatcgcagatgtgttgcctgaattgggcgaacaaaatatgattcaaatgacttacttccaatatgtggcacgccggttaccaaacatgggggtccagagcctttttgaccaattcgaaacaccggttaacgaaaccgatggccggattagtcgcttgaaagaaagtctcgtcttttataaggctgttaaaaaatacgctgcgcatcttgaaaaagccgacatgcgcttccgcgatatgaaggtcaagggccgcgtcttgattacgaaggaacacatcagcgaggtttattaccggtttaatgaaaactaccatctcggcaatcgattagatgcgactaaagaaagtttgttgcggacattgagccacaaggttgatcacgaaaccaaggctgactgggtgactgagcaagccgagaatatgagtgatgaagaaattcgcgagttgatgtctggtaaagatttcaagacgggtgacgctgaaagcaagtttatcgctaagcaaatcgtgctagaggccttcaaacccgttcgccggtctattcaacgcaatcgcttcttaagcatccaggcgcaatatattcacttcttacgggttgtgccacaacttgtgaagttagccgattttgatattacagaagagcaatggcaagaccacgtcacgcattttgtcgcacaattgaaggctaagcagatgacgttgcaagatgtcacaccttatcttcacctctacgatttgatgacgggtaaaaaaggcgaacgtgatatgcgttttgtcttcatcgatgaaattcaagattacacgccttatgaattggccttcttgaagctccacttccctaaggcgcgcttcacattattgggcgatttgaaccaagcgattttcactaaaggcaacagcacaaatctcttgcaacaagtgcaacaattatttgatgcccaaaatacaaaagtggtgcaattaacgcgttcataccggtcaacgcaacaagtgaccgactttaccaagggcttattaaaaggtggccaagccatcgaagccttcaaccgcgttggcgataaaccaaacttaattgtgcgccaatcagaagctgagttagtggctgatgttaaccgccaattagccgcaaatgaagcggataaattatcgacggcgattattaccaagacattggtgcaagcccaagaattgacgaagatgctcaagaaaacgggaaccaaagtcaccttgattcgttccgaaaaccaacgtttagcagccgggacattagtggccccaagtttcttagctaaaggtttggaattcgatgccattattggctggcaaatcagtgccgccaactacaatcatgaagatcaacggcaattgctctacacgatttgttcaagagcaatgcatcgcttgaccttgttagccactgatgcactctcaccactgattgataacgtcgatccagaaaaatatacattaataaaataaatgaaaaacgagatgaactattatgaaatctcgcgagaagaatggcgttattttcacggccgtggcgaaaaatacaccgccattacggacgataaattacagcaagtcagcggcttaaacgaccgcatctcgttaacggatgtcagtgacatttacgtgccactccgttatttattacaaatgaagtatgaacaattccaagaaaatcaaattaagcagtctgaatttttagaaatcaaaccgcataaaaccccgttcattattggcatcgccggtagtgtcgcggttggtaagagtaccaccgcacgcctattacagctattactgagtcgggtctatccagataaggcggttcaaatgattacgaccgatggctttttatattcaacctctgaattgaaacaaaaagggattctcgataaaaaagggttccccgaaagttatgatatgccgcagttgatcagcttcttgaatgctgtgaaaaataacgtggcgccggttaaagcgcccaagtattcgcatcaaatctacgacattattccggatgagtttgatatcatcgatgaccccgatattttaatcgtcgaagggatcaacgttttacaattaccgacgaccgaacaaatttacgtcagtgattttttcgacttttcagtttacgtggatgccaatccaagtttaattgagaagtggttcctagaacgctttgacctcttattagatctcgcaaaggatgacccaacgaactattattatccttatgcgattagtgatcgcgccagcgcctttaagatggcccggcgtgtctggcgtgacatcgatttacgtaatttgaacgactatattttaccaacaagaaaccgcgccgatttaattttgcataaaaccaaacatcacctgattgataaggtatttctacgaaaatattgattggcccaaaaggacatgcaagatttcgataagattatcgttttagattacggtagtcagtataatcaattgattacacgtcgtatccgtgaattcgggattttctctgaattgttgcctaacacgacaacagcagcagaaatcaagaagatcgcccctaaaggaattattttctctggcggcccaatgagtgtttacgatgatggtgccttttcagttgaccccgaaatttttgaattagggattccaattctcggtatttgttacgggatgcagttgatcagtttcaaaaatggcggtaatgttgaagcatcaacagaacgtgaatatggtaaggctgaaattacagtgactgacaaagacagtgacttattcaaaggtcttcctgaaaaacaaacagtatggatgagtcatggtgataaagtgactgcaattccagaaggttatgtgacagttgctgaaagtgataacacaccatttacagcaattgaaaaccgcgacaaacatatttacgggattcaattccatactgaagtgcaaaacactgaatttgggaacgatatcttgaagaactttgcatttggcgtctgtggggcccaagacaactggacaatgaacgatttcatcgacatgcaaatcgaaaagattcgcgaacaagtcggtgacaagaaagtccttcttggtctttcaggtggcgttgattcttctgttgttggggtgttattacaccgcgcaattggtgaccaattggtcagcatctttgttgatcacggcttactcagaaaaggcgaagttgaacaagttatggaaagtcttggcggtaaatttggcttgaacatcatccaagttgacgctaaagaacgtttcatgagcaaactcgctggcgtttctgatccagaaaagaaacggaagattattggtaacgaatttatccaagtgtttgacgaagaagcaactaagttaaacgggattgacttcttagcgcaagggactttatacactgacattattgaaagtggtacaagtactgcgacaaccatcaaatcacatcataacgttggtggtttaccagaagacatgcaatttagcttaattgaacctttaaatacattatttaaagatgaagttcgtgaccttggcgaaaaattaggcatgccatatgaactcgtatggcgccaaccattcccaggtcctggccttggtattcgtgtccttggcgaagtgactgaagataaattgaagattgtccgcgatagtgatttaattcttcgtgaagaatttgcactcgctggtttagataaaaccgtatggcaatactttacagtcttaccaggcatccgtagtgtgggtgtcatgggtgatggccggacatacgactacacagttggtatccgtgctgttaactcaatcgacggcatgacagccgacttctcacgtattccatgggatatcttgcaaaaggtttctgtgcgaatcgttaacgaagtcgatcacgtcaaccgtatcgtgtacgatatcacgagcaagccaccttcaacagtggaatgggaatagatggtaaatggtaaacaattagaaaccagtgaaaagatcaaacaagggctcgtttttgcggttgcaaaactgattcaaatcttaccgctgattggcttaacaatgttacatagcggtcataccgcggcatcctatatgccgtatatcttattttataccgcgttgaaaaccggcttattattcgtgaatagtctgggtcacgtgcagaattcgtttaaaataaccagtatcagcatgttattagctgctggggccttattcgtgttagccatttcgccgtggttatatttaacggatattgcggcctttattttgggcgccagcgccagtgtgattatgccgacctatgaaggtgtttattatcacgagcgggtagtctggaaatggcatctgatggggaccgaaattaaaacgttattggcttttagcttagtaacagttggtctattgaccatcgctagtcatttttcatatcggttagtctttattgttatcatgctatttgtattgattggctttgtcgggatgcaacgcttcgaaccatttgtgaagcaacttgatgaatcagtatttgtcgcacaaaccaaatcacttaataacttggaactatttgtctgggcaaccgcgatggcttttgcgctgagatatctgcgcctttttgaagcccgatttgtctggttattaattaccgttgctgtcattggtttagtcgcgctagtcttgcgggtgatcatcacgcgtggtactaaaacgaagatgccaggttggctcttgattgcggccttaattaacggggcgtttgaaacgtttttaatgctctatatatttgtcgcgatccaaaatcagggcttgatgataggggcctatgttacttacggtgcggggatgattctagcccaagttattcgaaagagcgtgcaagggcgcttttcgaagttatcagatttaaaagtccaactactgggttttgtggtgggtgcttggttgatgattacgccgcatctaattttattaggcatcttattaattagtttctttggcagtgctaacagcattcttttgaatcaccgcgcttattacaccggtgtcacaacgcccgcgcaaaccttaatcgttaaatatcggaatacgtatctaggtagtatcctgatgcaatttatcttgattattggcttgatgggcttagccgtaatgcggcaacaagacatgacgaccgtgattgctcaaatcagtggcagtgtcgcaatgtcggacaccaccagccagttgattcacttggctggtctgattagcgttggcttcttaacgctgattgccggattggtaggcagatatttaccagcgatggatgaaaatccgctggtttaatcaataaagagtttgatctattccatatagttcaagtaaatctttaaatttaatgggagtacctaccagtcgtaattgatttttaaatctattatataactgttcaagtaattcaatacgagaagtatctaacccaaaatgaaccattcgatggcaagatggacataaagaaactatgttttcaatagtatcgatactatgttcgaacatagcttgataagcgataggaattaaatgatgagcttcgacataattctttttagttttacgtgatataaaaagtcgatgattggaatcaatctgacaagtgtaatttgctaactgaattgcatgagcacctacacgtttatttcttgaaaattggttagttgtgccgctaattaatcctgtagaatcccgaggagtgacgatatgtgtaggaagggaagtggttctagctaaagtctcttccacatctattagatagtctaaatcttgatgatgattatcgggagtttcagaatgaattttatacttaatatagttagaaactgcagaagaatacattcttttgggatcattaggcatctgcttttcaagcctttttactttaattaaaagatcctgtaaatcagttaagacttttaattcgtagaatgatatttttaactctttaaaaattcgattatgcgcctgatttgaatatttggctatagtacttgttgatagcctctttaattcaagccaataaataaaatcttgcttttgtttattagtcaaatgaatttattagagatggtagctgcaaataaattaaaaaagactggtattactaaaaagatgtccgtttcagggcaaataaataacgatccgtatgaagttgtcgcggttcctttagaatacctttactataatgaccagaacggacggataaatacgacctataaacagtatcaatcagaacatggaatattaattccagaggctggggattcgaaatataatgagatatttgaagattttatttacaaatcaaatgctaatgcattgaaagatacattgcaatcaatcaaagacaaaacccagcaagagccaggtgttgttttaccagatggtcgggtgattgatggaaatcgtagattcactgcattgagaatgtatcaatctgaggataatatagctaaaacttttgaagcaattattcttccgttagatgctgctaagaaaactgatgaaaagacgattaaggaacttgagctagatttacaactgggccgagaagaacggattaattatgatccgattgatcgaatatttgatgtttacaatacaattaaagttgaagaattgatgacagtagaggaatacaaaaaagcttctggagcaggaaatacaaaaggaattaacagagatattcgccttgctgaattaattctaagatttattggaattatttctccgggtggcgaaccagttaataaattctttttagctcgcgacttgaagttagatggtccaattgaagaaattgagggtacgataaacaaattgaaaagttctgataaagaggctatcactgatgcagttttagtccagttagcagtagcaaagactaataatgaaaatcaggatgcgacacgaatagtacgtgatttaaaagataatgtacttaaaaaaccagatattttagaacattatatggatgcagtagatgataaagtggatgatattattgatgcttttaaagaaaaaccaattatgtcatcgaatgagttgaagcaaacaatcaatcaagactctgagctaaaagaagtagtggagaagtttacacaatcgacgaatcgtttagtgcacaaagggatgaaggataaaaagagaacacgagtaatttctgaactagaagatattatgtataatttagatgaaataagtgtggatagtttctcgaaccttactgtagaagaaaacttaaatgccaaagacttattaaaggatattactgatattttgtataagttaaagaaggacttaaaagtatgaatgacgttttctgaaggtataaaacatgcattgcaatcacaatatacacagggtttagtgacggatttttaccagccactgctaaaggaagcaacgttatatcaacgagtttctggttactttagtagtgctggactagatctttacgtggatggattagaagaacttgcaagaaacggtggcgaagttcaatttattatttcaaaggaaatttcacaagaagattatttaaaaattaaagaaggctacgagttactggatagattaaaacctttaaagatagctgagcgaaacagccaattaacggataaagcacaacaacaactcgggaacttagcctttatgattgcaaatggctgtgctcgagttaaggttgctttaacagataaaggaatttttcacgataaatttgggattatttcgtctaatgacgaccgtattttctttaatggttctatgaatgagactcaaagcggaataaatacgaattacgaaagtattagtgtagatgtatcatgggattctagcgaatacgttcagaaaagaattcaggcgaatattgatcggtttaatcggctctggaataattgtgaacaagatgttgaagtggttgaaatatcagagttagcatatgaagaaattgcacagtaccagaatcagacaacaattaaggaaataaaaccgattgaagataatccggatgcaattgaggtatccgaaaatagaattgattttcaattatttggaaatactgtggttcgattggatactacaaaaggtaagttaacaagtacagatcgcaagttaaaaattggtagtgacttgagtcttttctttgaggctgacaaccaaacaattaaaccaacaacaacttacaaagatattgaacgaattattagtgtaactgaaaaacgagcagatagaaagaatattaatataactgtttctgacgccgttaaacgatttatttcgcggaataagtattcaattgaacaatacagaatattaggtgaagtttataaaggaaaactagatgatttcccacaaaataaaaaagtgtccttcgaagaattttcgagcattgttcaatctgaagtggctagacctttatttgatttacatttacgggcagcatactatgaatatgaaatggcgcgtgctgctaacttttctgtcccgggtgcgggaaaaactgcaatgttgttaggggtttttgcttttcttaatcgtaaagaggccttaccaaatgaaaaaattgaacggttacttgttatttcgccgattaatgcgtttgatagttggaaaagtgagtttggagaggtttttggtgataagaagaaattagtttcgattgattctcaacattctaaggattttagatatcaattgaatacagattggggagtaagtaatctagtactgataaattacaaagcgcttcaatcttatgctgatcaattacagaaactggttgatgataaaacaatgttggtttttgatgaagtccatcgaattaaaaatccgaatgggaaacgggcagagaaagctttagaaatcgctcaaataccacaatttaaatatgtattaaccgggacaccaattccaaatacgtataaagacgtatataacttcttgcatatattatatgggaatgaatatagttcattttttggctgggatgcgaacgatttagtaaatcctaagcttcgaatgattgaagaaattaatgaaacgatgcatcctttcttttggcgaactaataagaaggatttgaatgtaccagcagcagatgacgatattatagaggaatgtttagccagtgaggaacaactagaattagcagaggctatttactataatgaaacttcaagtcttgctaaattaattcggttgatacaagcatcaactaatccatctttggtaaatactactattaattatcacgaattaatggcgtatgatgatgacggtgacacggtaggaatttcgaaagatgattttgataaattattagatgaaaatgatacgaagattcaaaaaggaagtatttatcagaatattagtaatatagaagcacctaaatttttaaaagggattgagttagtaacaagactagttagagaaggtaagaaagtgcttgtgtggggcattttcgtagatacaattcaaaaaataactagtacgctcagaaaagaaggaattaaagttaatttagtttatggcgaaacggataagttagaacgagtttcactaattaacgaatttagagatggcgatgttcaagttttagtttctaacccccaaacgctaggggaatcaatttctttacatcagactgttcatgatgctgtttattttgaatataatttcaatttaacatttatgttgcaatctcgagatagaattcatagattgggacttgatccagaacaacatacacggtactattatttacagacgaaagatgaagatgtatttagtgatcaaccaggatttatcgatcagaaaatatataagcggctaaaggaaaaagagcaaattatgtacggggctattgatgataatacattgtcaatagaatatagcgaaaatgaaatacaagatgctattaggattattgatgaagaacggaagaggataacaaaaaagcatgagtaaatgagtaattcgaaaattaaggttgcagaaatgtttgcaggtgtgggtggttttcatttaggattaacacgagcaagcaagaattttgaaatagtatgggcggatcaatatgaaccggatagaacaaatcaatttgcctttaatatatataaaaataattttccgcatactaatgttactaacgaagatatttctttggtaaataagcaagcaataccgaatatggatttactagtgggaggttttccgtgtcaagattattctgttgcatcatcaggagcaaaagggttttacggcaaaaaaggtgtattgtggtgggacataaaagaagttatagaggcgaaatggccacaatttatatttcttgaaaatgttgatcggttattaacatctcctggcgtcaacagtgaccagccaggtagggatttcggcatgattcttagaacattatctgacttaggttacggtgtgtcttggaaaatgattaatgcggcagattatgggtttccacaacggcgtagaagaacctttatttttgcatttagagaagatactaaggttaaacttgatgcaaaagaagttattgggaaaaacgagtcagaaattaccgagtttattaaaagtatggcaccactttcaaatacattaaaaattaaaacattaggtaaattaaccaaagttgatttatataagtatcaatctttatctgatttttcagataattttaaattaaaaaaagcttttcgacgaaccggtttaatgattgatgggtctgtatatatggctgattatgagcctattgttagagaacccagaacattagcagatataatagaacctaatgctgaaaaccaggaactgtatctgactcctgaaaaaaagaaaaagtttgaagaattgaagggagctttccgaactactaagatttcacggacaggatatgaatataagtatgggatgggcagcatagcctatcctgatccattgaataaaccagctagaacgatggtaacttctgaacacacagtgtcgagaatgagtcacgttgtagaagatcctggaaatggaagatatagagttatttcaccacaggaagctgagttgattaatacattcccaaaagattggacaaaacttgaaggtgtaagtaatccaaatcggtatttcactatggggaatgctttagtggttaatcttgtaaaagagattggtgttgaaatagaaaaaatagtaaaattagaggtaaataattctaactttagtagtagtaaaacagtggaaaaaatcgagcattgaatgatgaagtcaattttattagtcggtcagtcaaatatggccgggcggggatttattcaagatgtgccgggattgcggcacgagcgcgtgaagatgttgcgcaatgggcgctggcaaatgatggccgaaccaattcattttgatcgcgaggttgcgggtgttgggccggctgcatcatttgcggcggcttgggtccaggcgcacccggatgaagaattaggtttaattccgtgtgctgaagggggcagttcaatcgatgagtgggcgagtgacgaaatgttgatgcgccacgcgattgctgaagccaaattcgcacaggaatctagcgagttaattggggtattatggcaccaaggggaaagcgatagtctaaaaggcggttatcaaacgtatgctgccaagttaacggcggtctttagtcatttacgtcaagcattgggtcaagcagacttacccattattgtcggccaattaccaggctttttaggtcaagaagggttcggcgctagcgcgacagaattcaatgacattaatcgggaaatggcgaacgtggttgcgcaagatccccatagttatttagtcaacgccgccgaattaacggccaaccctgatggcattcacatcgatgcggcctcacaacggcgttttggtttgcgttattacgctgcttttgccaaccaagaggatgtcctcgcagtactgccagatgaagctgctcaattaggagtactttatcaacggccagaaaccccgcaggaaaagatgtatcgcttgagtcgtgcttttgcacttggacaaatgagctatccagaattcatcgcgcaattaacgggcaaggggactgccaaatgaatgattcagtttctaattttgggtttattgaagaaaaagccaggtgcttatggctacgaattattagctgatatggaaaacaattatttcgaattctttttgaactttacgaagggttctttttactacaacttacaacaactagcggaaaagcaattgattgaaaaaatagtggatgatgccagtgataagcgcgagaaaaatcgctatgtgctgactgcggggggagaagcggcttttgaaaaacagttcgcccattatggcgggcagaataagccgattactttcccattctacacaccactactattcactgatcaagttgaaccaacgcaaatgcgcgaactcttgcagagccaaattgcacaaactaaggaaaaaatccaagcgattgaagtggcattaactaccgcaaccaatctgcaaccgatgtttatcaaaatgatggccaattcaaaacggcaccacgaggttaatttggaatggttgcaggaacaattaaatgaacaataattaatttggaatggttgcaggaacaattaaatgaacaataaaaaaactaaccgctagtcctaatgcggcaatgccaatgccaattttagttaggcgttctggtagtagacgaacgatgatggggccaatgagcaagacaaggccccaaatgatggtcgtttgaagcgcgtagactagtgttgcgatacagttcgcgagacccatcgtcagatttttggtggcgttgtattcttgaaacggcgcttggctgatgactgaaagcagtgatagcatcaagacgccagaagcagccccgaagtagccgctgtaaacgccgactaagaaaacgccgagccaagcgagactaacttgccatttagcgggttgaccaacttggagatggcggggtaagaggattaaaatgccggcagataaaatgaaaaagggcacaattttttggaatgtttctgctggaattttaaagagtaataaggcccccacaatacagccaatcaaggttagcggtaaaagtgtgatgagttctcgtttttgatgttttaattccttgcgtgaagcgagtgacgcgccaacgccggtgaagattaagcctgcggtgttggtgacattggctgtgaccggtggtaatcccagtgcaagtaaggctgggtatgaaacgagtgatgcgagaccgccgacggtactaacgatgccggctgccacgccaatcaaaattaatgtaaggctcaattggataaatgacatttataggacttgatcgtagtaacggtaggcgcaatattcaacgggatacttgagtgcgtagatgtaaaaagcatcgctgacagcgtcactgatggtcattatttcactaccaccatcagttagtaagaaataagtcatggccagtgccagtaaaataacgattgaatcaagaaaaatagccatcaccttagcggctttgatggtgattaattgccagcgttcatcgttctggtaggcccgcgacttattgtgtttgaagcgaagatctaaaaagatgaaaactgctaacagaacaatcagaattaacatgatgagttgcttcattcattttgaatcctcctctggtgaaaagacagttgttatttcgaccccaaagacctgcgcaatcttaaaagcgagttctaatgagggtgtatatttatacttttcgattgaaatcacggcttgcctggaaatgccggttcgttcggcgaggtcagcctgggtccagttgcgctcagcgcgtaagactttaatgcgattttgaatcacatgataaaattaatcacttttgattgttatgggacgttggttgatacggcaccattttatgaggctgcgggagaaattggcgtgcaacatcagattgatcgcggactttttcaaaaagcttttgagctgtatgaagatcgaatgatgtatggcgaatatttcatgccttacgaacaggtcatcgaacaagccttgcggtattgtgcgcatgatttcaattatgagtacgagaatgcagatttaacgcaaatgttaacggtgcaggctaatttaaaagttttcccagaagtcatcgattttttgaaaacaatgaaggctaaggggattcaattaggaattatgacggatgcttcgttaccaattctcaagcagaatttggcgcaaatcccagttgaatttgattatttatacacctctgatcaattaaactgttataaaccaacgcttaatttctttggccaagttgctgatcaattaatggtgactaacgaggagcatttgcatattgctgccggttattggtgggatatcattccttgtcagcgcctgaattggcaacggatttgggttaaccgcaagcaagcccaggctttaccaacaaccgtaatgcaacatgaagtggcagatttaacagctgcaattgatttaatttaattatttatttaacataatatctaaaatcacagggtctgtttcccgaaggccttctgtgcctaaacgtccgatgccgtgaattgtctcatcgattgttgggcagacaatgccgttactatttggaataacaattccttgcaaggcgaggttaacgccgcggtacattgaggaaacggcggtggcgactttcatggcacaagcacagccggccccgtcgcagatcatcccggccgcgtcgccagccatgttttgaatcgcatgacaagcatcttcgtaagttccgtcatagagataaaccacaccagccgcggcccccattgcggccgaatcagtcgcgcaaaaggcggataagacgggcaaaaatgagtgaatgtatagggcggtgagatgggataatgtttgtgcccgaatcagctgttcctcagtcgcctgaacggcatctgccgctacgctgaccggaatggtagctgtgatgccttgattaccggaaccagagttggacatcgcaggtaattgcgcaccacccatgcgcgcatcggaagccgctgccgcgtaagcaatcatccgattaccaagatcgttttcagtgccagaaccaaagtgattacgtttggcaccattaattgattggccgagttgaagaccatagtcgtgcgtaaagccatcttgggcaagcgctagattaagggtgtgtgcctctttcatgaaacgaaggtgttccaatggttcgttcatggcaaaatcccaaacagccttaaagttcatagtttgtaaaaattgttttgattcagagctcgcgtgcgccgcgggacgggggtggtcaattaaaatttgatcatctttttttaaagaaaagatattggtatggctgccagcaatcgcaacggtgaccgtattttcaagatctttaatggtcacttcaacatataaatcgtcagggacaagtgctgttttagcagtcactttaccagaatgagcgaggtctagaatggttggtaagtctgtagcgcgaaggccttcaataacgctgaggccaaccgtcgcgtcaccagcaattgcccccgcggccgcagcaactaataaaccaggttcgccagtaccagggaccataaccgctagggcatttttcatcacgtttggtgaaacgtgcacctcaatggcttgaatctcgcgattagtcagttgggccatacaagttgcggccccaaaggcaacggcaattggttcagtacaaccggtagcgggcacgacaccatttttgagggcttgaatgaaatgttttgattgtaaagacatttaaatgaatgctaagaacggtgaaatcatcagtagaataccggtaaaaacgatgagatataggctaggacccttgagcttattgagagcgggaacacgatagacaagatagacggggattaaacaaccaatcattccgaaaattggtgaacataatgatgtaaaacttaaaacgggagcatttagtaagattgcgctccaagaaactaggatagcgaagattaaaataccgaagctaaggttctttttgttaatcttatgctttggcataatccgatgtaaaatattaacggcaattccctgacaggcttcatggaatccaagaaagacaccaaagaaggccgtcataacagcgaaaatatttaaaatgaaactgagaattttaattgaattaccgttcatattctgagcagcaatggcgagtgtcgagatgttcttctcgtaagcttcaactgcttggtcatgacctaaagcaagattgaatgaaatggcatagaagaagacaacgaaaaatagtgtgaaaaaggcaatattcatagcacgaattgatttatagcgtgctacttcaatatttttattgtgggatctaaacgaaataaccattggtgataaggattggaggaataaaatagaagtgagtgtgaaaggaagcaagatgattgtttgtttaattaagtaacctaaatcgggaaatgctgcaacatttctaagatcccaatgttggatcatcacaacgccgaggacaaagacaatgattagtttcgtacaaaccataaaggatgaaattttgaaaagtaatttttcggcacgagaagcaattgcgacgagcaaacaaataacaatcaacccataaaatggattatttgaccagactgttttagtaacatggaaggaatgtaaaaatgaagcgctatcatttgtaatcgcagtggaataaacaaatacccagattagtagcattaaaaagtagagaacacctagtaggaagccccaatttttacccaaataaccactgataacactaggatagtcttcgcatttttcagattcggctaaggtattgatgaataatttttggaataaatacatagcaggataagcaatcacagctgaaaccaggaaaacccagaggccaactaaaccgactttaacaggtaaaaaaacaatgccggcaccgattgccataccaatactcataaaaacccagccccagtctgtgccgtcaaacttagtggccgcctgccattccgttaaagacatgcctgccttatcagcatgtttttgagatctcgaaagatgtggtgttgattgtgtagttgtttccaaatggttagcgaattagagagatatcaaggattagttcattttttaggtcaagttttaggtagtaattatgaagttgttttacactggattaatcaagatgattcgtactatattgcagcgattgagaatgctgaaattagcggacgtaatttaaattctccaatcactggtttcgcgttagatcttattaggaataaaatatatcaaaaacaagatgctgtggttaattacaaggctagtagtgataaaaaccaacaaattcaagggtctacttacttcattaaggataatcagggtgttttgttgggattgttatgtattaattttaatgcgcaaccatatttagcggcggttgataatcttattaatcttgctaatctggattcgttaatggcatcagtacctacagtggctagcgaacatcaacagcaacgccaagtcgttacaaatgaagaagtgctccattcgagtgttgaagaaatcatttatgcggtagtagcacccaatacactgcagccaggtattaagttaacgcaggataagaaaattgaaatttgtcgaaaattaaatgaaaaaggtatttttaaaattaaaggtgctttatcaaaagttgctgagatattaggcacctcggaaccaagtatctatcgatatttaaaattaattaatcagtcataattaaaccgtcaatatctctcgaatgccttcttcaaacgatgtaattttaaattcagggaagcgagttttgaatttatccgaaacgaagatgttgtcggcttgataacgggggagcagctcttgtagttcgcgactattttgattgaagaaacttgctaatttgaattgccacattttaataatcgaataggatataggttggtacgtgatttcttgaatcagttcaactaaacccttgtaagtaatgctatcggcacaaggaaggtgccatgtttgaccgtaagcatcaggggtgttgccaattaaagccatggcgcggctagcatctggtgtccaaattaacgtgcgcaagaattgatcactaacgggaatacgtgctttttgcccggctttgattttgttgaaaagaagtgtattggtaatactattggttttggcgggaccgtaaaattcaggggcgcggcaaataacagtctctatttgacctgcttgcatagcatcgataacggtttgtgccatttctgcccgagcggttgccttttgaccgtctggttggaagggactgttttcggtttgcggtgtcgcatttttagcgtacatataagtgttatcgaagaaaactaatttactgtggttgatttgacaggcgcgaatcacattattaatcataatcggaaattgaacggtccacatatcagaattcataggtaaaccggctgtgaaatagacaatttcgctccctgcgacggcctgattggtttcttcaaaattgagcagattagcgggggagagttgatcttcaggattaaccttccgcgggttacggctcacaagtcggatgtcgtgagtatagtttttgtagagttcttttgcgagttcttggccgatttgaccgctactgcctaaaattgtttgcatttatttggtgtgggtggtcataatttgggtgactttatcgagaaattgcttgagttttacaatttcggttgtgtcgtgattgaggtaataaaaattcttcgtgccttctgcgcgatagtcgattagtttggcatccttgaggactttgagatggtgtgaaaccgcgggtcgcgataagccggttgcttcagtgagttcgctgacttgtagcccgtcacaatcactttcctctaataagcggatgataatggcttggcgctttgggtcacctaaggcaattaaaaattgactaacatcggttaagtcttgttgtaatgctttgtaatttggcatttaattctctaagctaatttgtgtgttttttgaaaaagggatgatagacgcttggcgttttggtttgaggaagcggtggcgatagtaacgatattgtggggtgaatgggtgggtagatactgcatgccaaggcttctcgtgaccacagaagtggacgattgctggggcctttttggcttcaataaattgttgttgtaaatgttgtgggggtgtggtcttatccatgatgatgttggtttgggcattccatttaggatggagatgcagccattgatcatgtaaaacagcattcagtgcatcttgatcatgaaagcgtaacttctctggatgatggttaatgaagtctaaagttttctcagtaatggcttgttgacgccatttcttaagatccattaacatcatgccggagttgaaatagcgcgtactgtgacacttaatggccattttttcgaggcgctgatggaacccggcgtcttcaaccgcagctagcgggaactcgcctaaatcaatattccaaaggcgttcaaggttaacgttacatagagcatcacagtctaaataaagcgcgcgatcaatgccgtttagcacttgcgggattaaaatccgataataagctgattttaaaatccgatcactttctacgatattggccaagagagcctcatcaactttgagaaaagttaaatcggcattaaaagcggcaaccacctgttttaatggtattttgtctgcttcagttaagtggtcttctaacacatagaaagaatagcggcgttgtgtgtcattgtgattcaaaatcgaagcatataaaatcgccaagggttcaataaaggcagcattaacagctgagacaatgttaatactgtctttttttaatgcgcctaattgttgactatacgcttggtattgcgctaaaaatggatgttctttcaacgtattccaaggtttattgtgcgttgtaaaatgaacgattttaggttgcgcaatagcttcgtcaaaaagttttttataagtggcattaattggctgatgtttgcggaagatgagtgaattttgtacattccaagcgggatgcaataattgaaccttaccggctaaaatggcattcaaagcgtcttgatcgtggaaaataattctctcaggatgctgattgataaaacgtagcgttaattcactaatttgattttcttcccaacggaaggtgtcaattaacatcacgccggaattaaaataaatgttacctgatttttcaggggaaacacctagtcgtggtagtgctagagcttgcccaggatcaataattgcgccaacaatattagtccctaaatggctttcataaagtggcgtaatgtcggtttggacaagaatatcgacgtctaagtataaaacgcggctaatccctttgcgtaatagtatttggggcgcaagaatgcggtagtaggccgttttattaatatggttactttcaggacaattttttaaaagttgttgatttattttaataaaatcgacttgatgtgattgcttggtaatttgtcgcaccaaacacttggtttgtggtgtgagttcattatcgagaataagaaaatggacagttgtctcagcaggaatatgcgccaatatcgacttaatcgcgattaaaagctggtcggcataattattatctgctgcgaacataacattgatcgtcttgataatcatatgttgaaagaagtgccaattaataaagtgagattaggtagaagtacagttaagacgccggatttgagtttgatgattgaaaaacaagaatcaaaattgaattgttttctagagggtgttactgatttagaattggccatcttaaaagcgaataatggcgaagcacttctagaaggaaaatgggggcctttggcagtcgatcgagttggcaatgttattaaaaaccaaacgattaaaccctatatacagcagtaaatggtttcgagaattttaccgattgaaaacgggcataacttcagagaattggggggttaccaaacattagacggcaaaacgctaaaaacaaaacgcctacttcgaacagcaaatttagctgatcttagtcccaaggatctagcgcttttaaacagttataacgtctcagtggatattgatttacgctccaaagatgagcgacaacaagcaccggataaagtaccagttagtgctaaatataaatctgttcctattttcaaagaagaccaaaccgaaagtacaacaactgaggcggaactctatcagcgctatacaaacaatccacttggtggccaaatgcaaatgcaaaaggtctatcaagaattagttcaagatgaacactcgattaagatgtatcgtcaattttttgaaatattacttcaacagtctgcggataatcaggcaacgctgtttcattgtacgggtggtaaagatcgaacggggatggctgcatattatcttttgaatgcgctaaacgttcctgaacctgttattcgccaagactatttactgacaaatactgcctcgcaacaacatattgcccaacgcatgtcacgattagcggctaagcacgcatccagtggctttataaaaagtacgcacgctttaatgagtgtgcaatccgcttatttagacaccgcaacaactacgattaagcaaaattggggttctacgcagaattatttacagaccgctttaaaattaagtaaaagtgatattaatcagttaagagcaacctatctaaattaaatggtcaaagcagatttgaaagacccacgtgagttatataaagtatccggatttgaggagcaagaacaaccagctccggcactacaaggcaaaatgcggccgaaacccgattgcggtgaggcagattatcaagggcgtgagcaattgatgaatcgcaaagtcctgattacaggtggcgattcaggaattggccgcgcagtagcaattgcattttcacgtgaaggtgcggatattgctttacagtatttacctggtgaagaaagtgatgctaatgaagtcgcggggttaattgaatcagctggtcgtaaggcagttttaatcccggctgattttaaaatgcaagaagcaccgcaacaagtggtagcacaagcagtggcacaattaggtggtttagatacagttgtgttgaatgccgcccaacagattgcccatccaacgcttgaaggcttacccatccaacaagtacgggatagttttgaaattaacgtggtggcaatgtatggcattgctaaagcggcgattgcccatatcccagctggtggtagtattctgacaaccacctcgatccaaggattcaatccaagttcacaactcttagactatgccgcaactaaagccgctattaggaattttacgattaatctcgcccaacaattagcagataaagggattcgcgttaatggtgtcgcgccgggcccaatctggacgccacttcaattagcgcaaggccagttagagggcgcattaccaaaatttggacagaatacacttttaaaaagagcaggccagccagttgaagtcgctccagtctatgtatttttagctagcaatgctgctagctacattaccggacagatatacggggtgaccggtggcgaatcaatcaactaaatgttacattggttatgggttttaattattggggctttaattggtattattgcgggggctattacaagtcgtgatttacccgctggttggattggcaatattgtagggggccttgtcggtgcctggttaggtcaatcattatttggtagttggggaccccaactagcaggtatggcgctagtaccttcaatcttaggtgccgtaatcatcgtattcttagtatcaatgctattttcacgtaagaaatcctaaatgaacaaattgacaaaaacggtaatcggcttagccagttttctgggattatgtcaggtagcatggttcattttgctcgtttatccgctaggactagcagatcaacaagccattaactttaactggctgtcagaagagtggattagcaatatagggctgggattgggcgttattagtggtctggtttttctttatttattattactagcaatttttagtttgccaaagaaacgtcagatgattattaaaaccaatcaaggggaattagctttatcgcgtaaagcggttgaaaaaacaatttcccaggcaataattgaaaaacaccgtttgaaggatgtttatgtccagaccgtttttaaaggtcgacaaccaaaggttagtgcagatattcaagcaaaagtgcttgataatcgggacattgatcagcaagccagagcggtgaaggaaacagcacaacaggcactcaaagaggtctttgacatgccaattaaatcagtaaatgttaagcttgcgccacttgttcatgatcaaggtcggacgcaaagtaaagtgatttgaatgaaacgttcttattggggctttattgcaggcgctgcattagcggcaatatggattggctttggatttgtgagcctaattttaattttgattgccggtctgattggctacattgcagcaagtttaacgggatccaaagatgatttagaaggttttagagcacaagtcaaccgcgtattaagacaagataaataaatggtagaacaagcacatttagatgacgtattagcaaacagcaagttaacgttcgaagatgctgtcattgcaaaaattgctggtaaaacagcacaaaatattgatgggttactatcaatgaatggcaactttttcagcgatatcgctgatcgattcagaactgatagcgatcctaccaaaggcatcagtgttgaagtcggcgaaaaacaagtggcgattgatatgactattattttggaatatggtcgcaacgcgcgcgacgtatttgaacgcttaacgtcggctgtcaccgaagctgttgaatcaatgacgggattgagtgttgttgaggtcaatagtcatgttagtgacgttatgactaagaaagaatggcaacaacaaggtagcaacgctaaaaagagcgataacgacgacaaaagagttcaataaatggataagccaaacaaaccaatggataagatgatggacaaacctaataaggaaacaccagatcataacgcacaaattgaaaaagaattaaacttttcagacggtgtgattgaaaaaattgccggtcaaactgttcatgatatcgatggtgtcttagaattatcaggtggtatgatgagtcaattagcagatcgtttcagagatgaagcagatccaactaaaggtgttgatgcagatattgacgatcaagaagtgacaatcgaattagatgccattttggaatacggtaaatcagccccagatatttttgaacaaacaaccgatcaaattgccaagtctgtgcataagatgaccggtttaaatgttacaaaaattaaaatgaatgtttctgacttgttgactaagaaagaatgggcagcaaaacaagaagcaggtaaaaaagataataaagataacgaataattattcaaactgtgctaaatctaaatttaatgcggttgcgacgcgtcgaccgtattctggatcagcttggtaaaattgtttaacttcgcgaatttgaatttctggtttagttacttgaccaagattcatgcgaatattttcgattaaacgggtttgttcatcagcggatagtagccgataaagtttgccagctgctgagtaataatcgggatcggtagagaagttgccagttgtaccagagagttgatcactatgaatcttagctgctgggacttcagtgggtccatcttgactatttggttcgtagttaacgcccgtttcttggttttgggccatgacaccgtcacgttcgtaattatgaacagggacttttggtcggttgattggcagttgttcgtagttggcaccaagtcggtaacgttccgcatccttataaccaaatagtcgaccttggagtaatttgtccggtgatgcttcaattccagggactaagttagctggtgagaaggccaattcttcgatatcttcgaagttattcgttggattttcatcgaggaccatttgaccgatttcgattaatggataatccttttgtgaaataaccttggtaacatcaaaaatatcttggggataattcaaaccatcttcataagggacgagttggacggcgacagtccaactgggataatcgcccgtttcaattgcgtcgaataaatcgttttgaaggtaatcagtatccttaccagcgagttcatcggcgagttcgttgctgagattatgaacgccttggttcgttttgaaatgatatttaacccagaattgttcaccttgtgcgttgacccatttgaaggtatggctaccaaagccgtgcatcattcggtaactggtaggaatcccgcggtcactcatgagaatcgtaacttgatggacagattcgggtgaaagggaccagaaatcccattgcatatcttggctacgggcatgtgtccgaggatcacgtttttgtgaatgaatgaaatcggggaattttagtggatcattgacgaagaagaccggcgtattattgccaacaatatcgtaattgccttcttccgtgtagaatttaacggcgaaaccacgaacatcgcggtatgtatcgggatagccagcttcaccagcgacttgagaaaaacgagtgataagcggtgtttttttgccgacgccactgaagacagcagctttggtgtaggcgctcatgtcttttgtgaccttgaaataacctttagcgccagcacctttggcgtgaaccactcgttcaggaatgcgttcgcggttaaaatgggcgagtttttcgagtaattgataatcttggattaagacgggaccgcgttggccggcagtttgtgaatgttgattgtccgcccatggttgcccttcgttagtcgttagttgatttgtcatttagcgatatttagcgacacaatcatggtgtaacgttttgtaaaaggttttgccataaatctgttgaaggacgctcccaagaagggaaaaccagtcctgtggattaaaaatattgttgaataagaaaaagtcgccctgtaatgcttcagcattttcgtaactatcggagataataaaatcagctaaatcaattcgatcagagaaagtaattgccgagccaaaaacatcttgtaaactttggataatcatattagcagcatagaaatttttggtatattgaacgttaatttttagcggtttaatttggacgttgtgatccaacaagaagaagaataaagcattcaacatggtacccatagtagtgctgttgagaagtttaggatagctttttgctttctcagtgagaaacttttgtagcgatttaaaaaccggatcagtattgaagttttcttctttgaaagcggacatcgagatactaaactctaaaaagccggtgacatcgacagagataaattctaagtagataagaacaatcacgagataataaaacgattctaaaaagcttgattcatcttgtttgagtttaaagtcaacaaagaagttttgtagtaattgttgtacatcatttgtaaatgccgtatcaaggaacaatattgccttggcaatggtgattttttccgtcgatgtgtcgtaattagctactaataagcggagtaaaaagctaaaaagcaaagattcatcttgcaaaacctgttcagaaaacccaggtaattcgatggttattggattagtatcgttgactgcagttaataattgacgcaattaatgtgacggcgtttttttctggattaaatcaaaataagtgacggttttcaatatatcaagttgatatcgttgtgaaaaactcagatggtctttaaccgagagcgtatattgtgaacggtttgttacaaaatcaggcaatattttaccgcggtaaatagcattgtaagtatagaccatcaatattctgatgtggagtggcttaccaataatattctgattacctctaaatgaaattgaaacgttaaagtgttgaaagtagtgtttcagcggtttaataatattttgaatcgtagagggtgaaagattagtagcctctgataaggcttgaattgagttaaagttgttcctaaaaagggcatccatcacttgaaatctatttgttcgtacgatgtaagtgtaacgaagcttaaaaattgtagcactaaatgaacttcctgttggatagattaccttatatttgctgtcagttgtcgttaattttaaacgagaatctagctcagtaagatcttgttgaatttctttgaggtagcgaatcgctgtaattttcgaaagggaaaattggtgcatgatgtctttaagtgttggagattcatctgcgtactcaatatatttaaataattgtagtaacgtaatggctttattagacaagaagaaatccttcatgtgactttaaataaacgaaatatcatattcagtttgttgttgttactggtaatgagcattcaaatgatagttactactggggtgagtcttgctgaaagcaacatccaaatagattcagacctagcgttaacaccagaccaagaattatctaatgagaaacaaatcgtgattaaagtaagtgaccaagcaaaagcacagcgtgatttaaagcttaatgtaccggcaggcacaacgtttgatgaaaaggccactgataaattaaatccagagccaacatattcggttgcgttcaatccaaaagataaaacgaatcagttaatacttaaagcgttggtaaaaaagacagttgaaaacgaaccagtcgaaacgccaaccaataccgaaataagtgaaagtcacacagtaaccgaatcaaccgccactagcgggttggcaccagtcgctaagaaggattacgtattagtttttaagattaaagatatcaagacccttgttaatcaacaattaaaactagcgaccgtgctagaaggtaaacgctatgaatctaaaccgttaatttttaaagaattcattacgctagaagatgccgttgctgctcagtctactgaaagtgcaagcaaggcaccagatttagtgaaagatacaatttctctaaaagaaaaacttccagcgtcaccttcaaagtctaactcagttcttgaaacaccatcaatcgatgaccctggtgaactagatggctgggttcaatctgataagaatattatggtaccaattaaagttgatcagtcagcaaatgaagcaaatcgtgaatattttatgtattttggtgggtactacacggggagtacaacgcggccaaatggtagtagtagttggggatcggggcaatacgaggtacctattggcgcctcgaccaaagaaaatgtgcctgatgcagcgttctttcaacttttaagtaaaacccaggctggtaaaatattttccgctgtttatgaccatgggaccaacagtaaccccactgatagtaaatttggtgaaacggggctctctttgttgacgactaacaccgattatgtggatccgaaacagtataatcccagacgaacaaataccaaggtgaatgcgcttggaactgatgcccctaaaaatacttttccaatttataaattaatgtataaaaaagacagtgcccatcctggattacgagcatacgcgatgacgaatggtgctgatggtcaaccggaaggtatgttgcgcgttactttggaaccaatcaatcaaaaaggccggattagagcgcagattcggtacatttctttagataagaaaccacgtttgatgacgggagttactcaatgcatatggatttggatacattacacacaagaacaccgacctactcactagatgcatatggatttggatacattacacacaagaacaccgacctactcactaggcggaaccacagggttatatacttatacggataaaacgccatctgataaacaactgtttagactgacttactggaaagatgggtaccccgatgatcctgaatacgaaatggtcaattctcaagatgatagtaaatattatggcaaacaatggggacaatatacaggtggtggggtctctatcctagcaccgggatgggaaatcaatgggacggataagaatattacggatccaggcaaatatcagctttataaaggccatggttacaatcaccccgtttggcactttaaatgggcttatcaggaagtgcaaccaagagagcgatatcaagtgaatatggattttggcctatcgagtgaagtggactacaacaacgttgaagccactaaatcgtatgagaatttgacctctaaagatggctataaccgagttggtgatcgactgaaattcaaactactagggcggaacacggaatgggatactaatttaaccaatatcatgattattgatgctattcctaaggattttatggtggatactgccacctttaagttagtagacagtacgggtaaggaacaagtcttaagcccaagtgtttatgatccccaaacagggcttttaaaggttgacgtaccaggatcaatgggctttaacaaaacagtttatatcacctttgaggtcaatattgctccgtctgcatccggtaagacagtcacaaattcaatggatatttataccgataaagcttccaaacatgattcatccgatgttcaggtcaaagttgaaaaggcgcaagtcttattacacaaacaagttaagaatttgacgacaccagatgagtcctatgcaactgaaacaaaaggaaaattaggggatacccttagttatcagattcatgctgttaatgtttcaactgagcgtgaggttaagccaggcgctgatattgaagatgttttagattcagccttaacaagtgatcgggaagtgatgattgattatttcgatgtcaacgggacaaccattcaacaagaaaccggtcagtttgataataatggacacctaaaattggcatacgctattcctaaagcaggtcatgccacactaacttttacagccaatattactgataacagtcaagaagttatcaataatagcgctcgagtaacctacgatgatggcgaaagtacgcagtctaataatacggttgttaacttaccaaagccgattatcccaattatgcaaaaagatgtgcggaatgtgacaaataacgatgctgaatttgttaaagaaacaacaggtgcaattggtgatgaagttgaatatcgtatcatggccgttaatgcatcaactgaagagcgtattcctaaagagacgatgttcagtgatcaattagatgaggatttagtcaatgatacgccggtgacagttgaatactatagcgtactaggaactaaaacggcgacgcaagaagtctatttccaaaatggtaaattcaaattgaattatgaaattgaacctagtggttatattatggtctacttcaaggcaaaaattagcaagacaactaaatcagttgtgaataatacagcgacattagccgagggaaaatcgaatgtcgctaaggttaatatcatcaaaaagacaccaccaatgcttattaaagacgttaaaaatctaactaaagctgatgaagattacgcgttagaaacagaagctgaagttgatgatcaagttgaatatcggatccaactggtgaatatgacttcaattgatacaaagataggtgctgttttaaaagatgttttagatccggacttgggcgatattcaacaagttaagattgattacctcgataaagatgaaaagattacagccacccaaactgcggatttaactgatgatcaggtgacattggatcacgtgctaccggctggtggccagggaatggcaattgcctatatcaaagcgaaggtcaaagaaactgacaagacagttattaataatcaggccagtttaaccactgaatttggtaaaggtacttctgatcgggctaaattaaacattaaacaaagcaaaggtcgaatcgtggttcgttatcgggaccgaaaagatgaaagccacaagttggccgaagatgagacctttgatggcaaaattggggacactagactagtgcaacccaaagttattccagaaacagacggcaattggaccgtggttgattcttctaatatggtagatccagattggggctcaaccacgaaacctgattggactttagcgcatgactataccgtcacttacgccaaagatgaacaagtcattacttatcgttacgaagaatcccatattggtattattgctgacaagcgttgggattttggtcaacatgatacaacagcaactgatcgtaattactatctaaaggctaagacgcaagatggtaagaaacaaccttatgaagtcggtgttgaggattactacacttctaaaggttggacactcaatgttaaacaggatgaccagttccataccaatgccaatgaaaaaattggtggtagtcagaagttcttagataatgctgtgttgaatttccataacggtcaaattgctttaaaagaaagtgatgatattggctcaaccgcaccagtttctaaattaacttccgaatttgaactagttcctgaaggtgcaccagttaatttaatgacgcataccaataagacacctgatcctggttattacgccgcgcatggctttgggatttgggcttatcaatttggggatgccaaacaggcggattacagcattggtttgaaagtgcctaaagcaacaaaacgattcccaagacaatatacaagtcaattaacttggtcactagtaatcgcagaataattgaaatttgttagatgtttaatggcagtgagcttggcgtttgtgggcttaatgctctgccaaatgacacaggttcaagctgcagctcaaacccaaaaagcggattttgaagtgcagcctatcttgccagaggaacaagaggatttaagtttaaattacttcaatatgagtttggcccaaggtcaaactaagaaacttgaaatgcggattcagaactttacggatcacgcgattacggttcattcagatttaagaaatgcgatgactcaaattggaggcggtattagttttcaagatagtccccaagggttagatccaagcttgaaagtaccattcactaagatcgctaaattagataaaaagagtcaaacgattaaattagcagcccaagaaactaaaattttaaaaatggtggttaaaatgccggaagatcggacaaacggtatgatttacggcgattggcattttatcgaatatctaaataaaaaaggtggccaatcatcggttggtagtaactacgcctactcagttggtgttgcccttaaaggacaacactacaaggtttatccagaattgaaatacgataaaactgaggccatgatttatcggcgacatgctgcaatggggattaagattcgtaatacacaaccgatggtcattaataaggtcagtgctaaggcagttgtttctaaggaaggtttatttgcatcaaagcatgttttcagtactagcaaccagtcaattgcacctaactcagttttaaccctaccaatttcgtgggactatgaccgtttgaaaccagggaaatacacgattgatacagttgttcgtggtcagaatttgtggaacaagttgccattaacgtggcacttcaaaaaacgtttcacaattaaggccgatgatgtcaaagctgttaatgcgcaagcacttaaaaacccactaacaagtgggcctatgttgctactgctagtggggtcttaaatgcttaataatcaccataatgctcgctttttgggccttgatgcttcaacagcaatcacagtttgttatggcggcatccgcggattcaaaacagaaagtgacatttatgatttatccagaaataccaaaggtggggggaataaactcggctacttcaatcttaaattaaaaccaaatactgagaagactttaaaaattaaggtctttaacccaacgaataagccaattaaggttaaagtcagcgccaaagatgcgcagactgcagacgatggtcgaattgattacttatcggatgatccggtttctaaacaacttttgccagagccggggagtcaatatgtccattttaaactacaagtagtcgttcccgctaatacccaaaaatgggtgaatgtaaatgttaagatgccggacactgcttttaaaggcaaaaaggcgttcgcgattaacttagcggcgatggggccaacaggtggcagtatcaacaaccgttatgtatatgcagttggcgttactttaaatgggagaaagttacctcgcaaagaattgcatcatttacaaatgcctacgatgcagacgggatttgttgataaaaaagcagccttacagtttaaagtgaataatcccgatccgattttctcaaaaagggtcaattatcaaccaagttaaatgcatatcgcaccgaattcgagtttcaacgccaacttgttgttaggcgggaagcgtttggtaccaggtcgttacacgatgattgctgatttcaagagtgatcagtatcaacgggaaattaagaaaactgttcaaattactaaaacggatgcgcgctacattaatgaccataatgcggcgtatcaaaaaaaacgccgtgtcttactaactgttattaccatctgcgtcttattagtggtgatatcaatttatgacattcggaaacatggaagtagggagtcaaagaatgattaaatgattaataaattaatcgataagtatcactattcaactgttaagtatacgttcattgcactaaccacactgacgaccatcttatttctggtgagtctagccttcgcaattgtgagttacatcaattttaatacgtataccacactcacaatgtagatgaaattcacaaaattgacaagtgcagctttaacagccggcacaatcttaagcattcttgcaccaacagcaacattcgctgccacagtagaacacgatgccaacgctaatggtggtacagaattaccaatgtctgataatacagaagttgggatctcatttggtgataactctgataatgggaatactggctacttacgtttacaaatggtaccgcacgtattagattttggtaaccatacagaattcttatcacaatacccaatatttgatgctactggtcataacgtaagtatcgatagcaatgatcgtcatgcgtcatacaagaacacggatacaaatatgacagctgttttaaatacaaacgatgctaaattagcagatgttaagggcaaagcctgggcgacagttgttgataagcaaatcacacgtgaaaataacgataccggcgatgatgctaaaacaacaaaacaaagtggtacatggcaattaaaagttaaatcagatgatgttttaacagcaactaataatggtgaaacaatcaataacgctaacttattgctcaaaaacactgcttatggtcagacagcagacgtcttcacattgacaaatgaagcgcaagatagtgatttccaagctgatccaacaattgatgacaaagatgtttcaacaattgctaagaacgtttcattatcattagacggtaaaggtcaagaagttgaagttgctaatgctgctgatactgaaggtcaaggcgctaacgtctttggttgggatcgttcagacatcaacttaacattgccaaaagattcaaaagttggtaatgacatctatacagctcatttaacatggacattatatacaggtgttcaagcttaaatggcaattaaatattcaaatgaatttaaagaatcgattgttagcttaagtcagactggccgttcggccaactcactggctaaagaatacaacgtcagtgtttcaacggtcactaagtggattaaacaagctgatcctaacaacactaaagtgctatcatcaaatgaacgtgctttgattaaagaaaataaacggttaaaagaagaacttgatattttaaaacgagcggcggtgctcatggcaaaaagctaagtgttagaagtcgtcaacgctaatttacttgctgggcaccgcattacgcgtatcttatcagtactcaaaattccgcgctcaacctactatgattatctacattggcagccaagtagaactgaacgccgccggcatttaattaaacaagaagtgttaacggcttggttaagatatccaatgtatggctacccacgattaacgatcttactaaatcaacagtctgatattcacgttagtcagcgtctggtctatcaacaaatgtgtgaattagggattagatttagaatggttaaacgaatcaataagccaaccactcagactgattatgatcagcgaccaaacttgattaagcagttaactgatcaatctggtattttattgactgatattacgtacattccccttaaccatacttggtgttacctagctagtgtctataatccagtaacccgacgggttattgcttaccaacttaatacgcagatgactaaagaactagcgactaacgttattacccaagtcatggcgcaagcagttaaaccacaaattattcatagtgatatgggaagccaatacacaagtgacttatttgaaaacactttatcgaagtatggtatcaagcattcttactcccgaaagggtcagcccggcgataacgcgcgaattgaaagttttcattcaattttgaaacgtgaatacgttaatttccaagattttaagacaattcatgaagcaatcgccggaattgataactatattcgttggtataacagtaatcgtatttcacttgtagcgtagctagtcatttaagttataacgtaatttcatgtgttctgagcctgaaatcaccatttcgcctaatagttttgtttggcgttgaagagattctgttgctagtttgttattagcttcttccaagaaggcaacggcatctttttgaccgtcaaaggctttgtcagtggcgttttggatttcgtgataagcgctcattgcttctaattcgaaggtattacgcatatcaacgtagaagtcatagtctgtatcgccaagtaaggctgttgtacagctcaaccagtacatattgttaaggtcgaatgttccggttgcattcttgtatgattcaggtgtgtcattaacgttggcgtaaaatggcacaactgtattgaaggtattagcaccgtaagctaaccagtgaataccagcgatttcagcagggacgttgttacgaacttgtaaaatgtgcacattgtggtttcggttaatcccgataggacggaagcgtgttttaacgtcttctggtgcgctaccgtaaggatcgtattccgtattttcaaagtgggcgctcaagacaaacttaacgtcttcgattgaaattttacggttggcatggcagatgaatggtaaatcatggtccataggatcttgtttgatttctgggttgaaatattgttgaccataccaagtacgagggttgttataaacggtatctttgatggttgcactaccgaaaatgtgacggaggttgtaaccttcaaagtctgggtttaagtgattatcatcaattaatgcttttaaatcagctgaacaaagtgtgttgtctgagccaaaggcaaagtgatcgatgttcatgcggttaggtgcaaccacgtaagcatcatcagggatgcgaacagcagcccagtgatgaccaccgattgtttcaagccaccaaacactgtcttgatcagaaaaggcaattccgtttggttcgtacgtgccgaattcttcgagaagcgcgcctaaacgttcgaccccttcttgagcactgtggatgtaaggcaatactaaagtaacgatatcttcttcaccgataccaccgggaacaagtgggtctaatccttgaatacgagggttagtggtaattgtttcggttgctgacattgtgacgttttcgctgttgatcccagcagctggccagatgccgtttgtgagtagtgagttaggaattgatgtataacgcattgagttatcaggtaatttgatttgaacaccactgattacggcttggtaatcgcgtggttggtcttctggattgacgacaacaaaacgttgaggatctagcgcttcgtgaccatcatcatttctagaaatcattgttgaaccgtcgattgaagctttcttgccgactaagactgtcgtacatgaacccttaattggttttttcatatgttatcaattaagaacctcaccgttgcttacgatgacacaccagtatttactgatgttgccgttcactttgacgcaggcaaaatcactggtatcattggaccaaacggtgcgggaaaatcaacgctgattaaagcaattttagggttggttaaagcacggcaaggctcagttttatatcaaggaaaatcaatgcgggctgtccaaaagcaggtcgcatatgttgaacagcgcaaggacctagatttgaattttccaatcaacgtttttgatgttgtattgacgggcacgtatggcaagttaggtctgtttcgtgatccagggaagcaggcaaaagccgctagtcgagcagcgctagagcaggtggccctcggtgattttgaacgccgccaaattggccagttgtcaggtggccaattgcaacgggttttcgtagcgcgcgcaattgtacaggaagcggaaatcattattttagatgaaccctttgtcggcattgatttgcaaagtgagactgcaatcatggccattatgaaacagtggcgtgatgcaggtaagacgattattgttattcatcatgatttgaataaggtgtcacagtattttgacgatttagtggttatgaatcacggtatcgtggattatgggcctactgatcaagtttataacgcccagaatattgagcgcgcatttagtgcggacttatctgccgtcttgtttgaaaaacaggaggtagaccaatgaatgactagtatttcagcatttattggcgcattagggcgctacgaatttttacaaagtgcattattaaccgccattatggtcgggattatgtcgggtattatcggaagtttcatcatattgcgagggatgtccttgatgggcgatgcgatttcgcatgccgtattacctggcgtggccgttgcctatatgctggggatcaatgtgctagttggcgcatccgtattcggtattttagcggcggtcttgattggctttgtcgcgacccacagtaaaattaagacggatacgtcaatcggagtcgttttcagtgcgttttacgcattgggctttattctgatttcgatggcagaaagtgcgacgaatctccatcatattttattcggtaatattttagcagtgagtgatcaggatattatgacgactgcgattgtattaggcatcgttatcttatttgtttcattcttctataaggaattattgattacctcatttgatgaaacctacgccagaacttacgggctcaaaacgcaggtcttacattatggcttgatgctggttttaacgttagtgacagtttcagcattacaaacggtcgggattattttggtagtggcgatgttaattacacctgctgcgacggcctttttatggactaataaactcgtgacgatgctctttttatcagctgggataggggcagttgcggcgattagtgggctgtatttcagttataccttcaattgggcgtctggcccggcaattgtcttgatggccgctgttttgttcgcgatttcgtttatctgcgcacccaagcaaggctttttgaaatggcgttcagctaagggaggtcaataaatgaagaaaatattcattactttattaaccgtcggtgggattattggtggcgtgtacggctttattcaccaacgggcacaatctaaagcacaagccaacaatcaacacaccaaattgcgggttgtgacgactaattcgattttagaagatatggtcgccaatgttggccaagagcgggttgagttgtacagtatcgttaaacgggggaccgatccccatgaatacgagcctcaaccaactgatatttcaaaagcgacggacgcggatgttttgtttcataatggcttgaatcttgaaacgggtggcaatggttggtttaaaaagttagtgtcaatcgcacataagaagtttggggaagacgtttttgcgacgactaaaggtatcaaggtccaacatctaacgaccaataaggacgaaccagatccacacgcgtggttggatttggccaatggcatgcaatatgttgaaaatattacagccgccttgcaagctaaggaccctaaaaatgctgattattaccgtcggaatgcggatcagtatattgcgcgcttagaaaaattacacacgaaggctcagacgcaatttgctgatattccagaaaagcggcgtgtattggtgacttctgaaggtgcttttaaatacttcggagaagcttatggtgtgaccccaacttatatctgggaaatcaatacggaatcgcaagggacgccaactcaaatgaaatcagtccttgccaaaattgcggcaacagatgttcagagtttgtttgtagaaacatcggtatcaccgaaatctatggctaaagttgcccaagaaacgggactgccaatttatgcaaaaatctttacggattccttggcgcaaaaaggaaaacagggcgatacctactacacaatgatgaagtggaatatcgataagattcatgctgggatgattggccagtaaatgatggataaagaagcagaaattattcaagcttttacggcgttattttataaaaaatcgtggttggaacaaggcattatggaagcgcagttgagcgggtataagtcttctgagattcattgcttggaagcaatcgccaagcaaacggatccgaatgtgaccaaaattgctgaagcactgcacatgacgcgtggtgcggctagcaagctgacgaagaagcttttgaaaaaagaagtaatcgagtcttatcaaaaagccgacaataaaaaagaagtttatttccatgttttacctgaaggtcaagcggtcgttacaaagcatgatcagctgcatcaacaatttcaagaacgcgatcatgtggtttttgaagaggcaaccgatgaacaattaacatcactcttgaactttattgagacttatagcgctcatattgatcaagccattgagaatcaaaagataaatcattaaatgacagattcaaagatgactaaattaccaaaggcggttttaacagctgcgtgggcgattgccctaggcgcgattgcgccaatgttagattcaacaatgatgacaattgcgattcaacaattaacacagacttttgcgacgactttaaatgtgattcagtgggcgattacggggtacgttttagcgctggcgattgccgtccccatttcaggttggttaatgaaccactttaacggtaagcggatttttatcggtgcggtgattgcatttggcattacctccgttttagctggttttagttggaatgtgacgagttttattattttcagattactacaaggctttagcgccgggattattacgccgttgatgtcaaccttacttgtgaagacggctggtcccgaaaacttggggcgggtgatggcgattgtcagcacaccgatgatttttggccccatcttaggcccggttttaggtggttttattttgcaagtggcttcgtggcactggttattcttgattaatgttgggattacgctgattgccgtcccactaatgatccattgcttacccaattttgaaccttttaatcgtcaaagtcgtttagatggctgggggattttaatgctatcaatcatgagtgcgacgttgatttatggcatttctaaggccgctgattatgcaacgtttaataatggggaaacgctgctctgggttgggattggcgtcctcatggccgttatttacgtgatttatgattggcggcgtcagcatcaaacggttttaccacttaatttatttaagcatggccaatttgctgttgcgagcagcgggctttttctagccaatattgcgattatgggaccgatgttgattttgccactctttttccagagcttccggcatttcacggcaattcaagccgccttagcaatgatgccccaaggaattgggatgttagtgacacggcctttaatcggtaagtaggtggttttactaagtttagcagtcgccttaatcggctcggttcccttgatgctgatgactgatcaaacaagcatggtttggattgcattaatcctatttgtacgaggcatcagcgttggcgggattaacttaccattgacgagtgatgcatatctcggcattcctgagcaacagctagccgaagcgggtgttggcatcaatatcatcgaaaatgtcggttctagtttcggctccgcattgattgcgacgattgtcgccacaattggtttaggcaatcatgggacagttcaacaacaattagccggttttcatgcaggcttcctggtttcggtaattgttttattactattaatcggaccagcattgaaattgagtcagaagaaatagatggctttttttggctataaggatatggataagttatcagatgtagatttagcaatttaccggtatattgttagtcatgatgagaaggtcccgtatatgcgagttagggaactggctgcgggggcctgcgtgtcgaattcgtcagtcatgcggtttattcggaaaattggttatgatagttttccggagtttaaggtgtctttaaagagtgaattaaaaacaggtgaacaaccaagcgatgagcttccattggtaacgatggaggctttttccgatgacttgcttcgactgattaagattgttggtgggattttattggaggctgacaatattttcttagtggggatgggcgcatctggggcgattgtggagtatgcatcacggcaattatcggcactgtgttttaacagtagtgcagtcaaagatccctattacccgctgtcttcacaactaaaaaatacgaccaataacgtgattattacgttgtctgtttccgggaaaacgccggaattaattgaaatgctcaataattttgtcaatgatccagatacaacactggtgacgattacgggtaatttagagagtcctttagcgcggatgggacggtatgcactgacttataatattgaagaatcacggattcaccaatattatgacatgaccagtcaggtgccgtgtgtctatattattgaagctattttgcgtcaattacgacaacaagttgcgttaaacaattaaatggataagtttaatagttttatggaacgcaccatcgtcccgtttgcgactaaattaaatgaacagcgacatgtcgcggcggttcgtgatgcatttatgtatacatttccgattacgatggcagcatcgctcgttattttaataaatggtagattgtaattgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacaacgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatgaatattctctctatttttatcgcatacttagtggctcgaaacctagcaaaacacttcaagtcagatgatatgttaatcgggatgaccgggattgcggccttcatgattttatacacaccagcagttgtcaaagacggtgtttcatatctaccaacgacgtatttaggcgcacaaggcttattcgtcgcaatgatttgtgggatgatcgtcggtgaattcttacctaaattattcaatatcaaaaagttgagaattaagatgccagaaatggtaccacctgcagtggcccgttctttcaacggtttaattccaattgttatcatgattatgatttttgcgatggctaacttcttcatttcattaatcgcaccacaaggcatcaacgaaattatctataaaacgattcaaaccccattgcgccatatcggggttaacatcttcgggattatgattatcgccgttgttcaaaatgtactttggttagtcgggattcacggccctaatacattgaatgctttacggtcaattatgtttacggaagctgatttagctaaccaaacattcattaatagtcacgggactgcctggggcgttccttaccgcgaaacttggggtattttgaatgacgtcttcgccaatatgggtggtagtgggatgacacttggtttaatcatcgccatctttattgcatcacggcgtaaagattaccgtgaaattgcaaaattagccctagttcctggtttgttcaatattaatgaaccattgatcttcggtttaccaattgttttgaatcctattttggcgattccatttgttttaacacctgtgattaacattttagttgggtacacagtgaccgttatctttaattggattccaacgcctgcctttgggttaacgtggaccacgcctgggccattgatgccattcttagggactggtgggaactggttagcgttaattatcggattcttatgtttaggcatttcagtattaacttatttaccattcgtcattgcagccaacaaagttgctttgaacaatgcgcaaaagtaaatggacaagcaagaatttccgcaagactttatgtggggtggcgcagttgcggcccatcaattagaaggtgcctatcaagctgggggcaagggtctcagtattgctgatgtaatgacactgggaagtcacggtgtgcctcgaaaaataaccgacggtgtggttgacggtgaatactatcctaaccacaacggcatcgatttttatcatcggtacaaggaagatgttaaattatttgctgaaatgggttttaaatgtttccgaacatcaattgcgtggacgcggatttttccaaatggggatgaagcagaacccaatgaagctgggttgcaattttacgatgatctttttgacgaatgcttgaaatacgacattcaaccagtggtcaccctatcccattttgaaatgccatatcatttagtacagcaatatggtggttggcgcgatagaaaattaattgatttctttaccaattttgcgacggtttgtttcaaacggtatcaacataaggttaaatactggatgacgtttaatgaaatcaataaccaaacgaattacgaagatggtggctcagcctacacggattctggtttattatttaaaccaggtgaagataaggaaaaagggatgtaccaagcggctcattatgaattggtagcgagtgccaaagcggttcaaattggccatcaaatcaacccggatttcgaaattggtagcatgattgcgatgtgcccaatttatccactgacatctaaaccggcagatattttatttgcacaaagagcgatgcaaacacgcctttggttctccgatgtccatgcgaacggcttttatccacagtggttattaaatcattttgaccgcaaacaatttaacctggatatgacaacagaagacatggtcattttgaaggccgggaaagttgattatattggctttagttactacatgtccttcgcggttcaagataccggcaaactagaataccacgaagatcaggatcgggttgctaatccgtatgttgaggcgagtgaatggggctggcaagtcgatccaatcggcttacgctacgcactgaactggtttacagatcgctatcacttaccattatttattgttgaaaatggcttaggcgcaatcgatgaaaagacggcggataatcagattcatgatgattatcggattaattacctacacgaccatattttacagatgaaaaaggccgtcttagaagatggtgttcagttattgggttataccccttggggctgtattgatttagtagctgccagcacgggccaaatgtctaaacggtacggctttatctatgttgatgttgacgattacggacaaggcactggcaatcggtatcgtaaggattcgttttactggtaccgcgatatgattgcgacgaatggtgcggaaattaattaaatgacaaattttgttgggattgatattggcggcacaacgattaaagttgggttagtcaatcaagaaggccaaatcgtacgtaaagaagcatttgaaacaccccaagaccaaacgacgttaattgctaaattagtgcagatcattcaggattttcaacaaacaacgccgattgcaggtgtcggggttagtgtgccaggtgtggttcaagcagacggttttctgacgacagctggcgccgttaaatgcttaaccggtgtcgatttgaaaggtctactgactgaaaaattgaatctacccgtggctgttgaaaatgatgcgaatgcagctgcaattgcggaacaatggttgggtgccgctaaaggtgttaccaactacctaagtttggtactgggtaccggtgttggtggcgcgttagtcatcaataaccaaatctatcgtggggcgcatgcgcgctcaggtgaatttgggtggatgctcgttgaagatgacgagattgatgttgaaatgggttccttgaacttcagaggtgccactgtcattggcttattgcggcgttataaccaattcagtgctgatcagctgactgatgctcggattatttttgaacgggcggcgcaacatgaagtcctcgcacaaaatgtgttaacgagttactaccacagcttggcgaagggaattattaatttgatggttgctttcgatcctgaaaaggtgattattggcggtggcattagtgccaacgaaacgtttatgacgcaactcaatgctgaaattcaaaacgtgcaaagtgttcataatagtattaaagaccttgcgttaccgacagtcgtggcggccgatttaaaaaatgaagccggtattatcggagcggtttaccaagtgatgcagaagcgctaaatgaatgataataaattaaccatcgatgcagatcaatttgcagcagccattatcgccggaaatccgaagcaaacaaacgaagacaacaaggtttatattaaacgtcaattgacgttatatcttgaatccgttttattagcaaacgattttaattcattagaagaaaaccagtttggcacagccaaggaaaagcaacgccaagctattttagaaaaaattattgaacaccgttatcactagatgaaaaaactaaaagatatcaaacaatatagttcatatgcattcggggcatttggccacgatgctttctatgcaacacttagcacttattttatgatttttgttactagccaattattcgatacaaaaaatgccgcttttaatgcaaaaatgatcggttatgtcacttccatgatggttgtcatccggattgttgaaatcgcctttgatccacttatcggtggggtagttgataatacccggactcgttgggggaaatttaaaccttggttactaattggttcattgattagttctgttggtttagtcatgatcttcacgaacttcggtggcttagcaacaaatagcccttatttatacttagttctttttgcaatcgttttcgttatcttggatatcttctattcatttaaagatattgcattttggtcaatgttacctgctttaaccgttgattcagaaaaacggacgaagtttggggccattgctcgttttggttcaacgttaggtgcccaaggggtaatcatcgttattgtgccaatcgtagtcttcttctcacaaatgttttcagggacacatggtagcgaacaaactagcgctggttggttagggtttgccgttgtcatcggtgttgtttcattcttaggcgctttagcaacgattatcggtactaaagaagaaaagagtgctatccgtgaaaatactgaaaagattcgtttccgcgatgtcttcaaagtaatcggtaaaaatgatcaattaatgtggttatcactatcatatttcttgtttgcttttagttacgttatcacaaactcacttttaatttactacttcaaatacgtcatgggtcgcgctgcagccttctcaacagttggtgtgattaccgctatcttaggggttatctcagttgccctattcccaactttagtatcattgattcaccgtcgtgctatctatcttggcgggattgccatgatgatgcttggctacattctcttcttatttgctggtagcaacttagttgttgtcttaatcgctgttgggttattcttcttcccatacccacttgttttcttagcagctttaatgacaattactgatagtgttgaatacggtcaattgaagagtgggacacgtaacgaatctgttacgttagccgttcgcccattattggataaattagctggtgcctttgccaacggtgttgttgggattgccgcaattcacgcaggtatgacaggtaacgctaaaccaagcgatattacaaatggtggtttattacaattcaagacatacatgttcttcgtaccaatggctttattaattgtttctgctttgatcttcatggcaaaaattaaattaacagaagcaaaacacgcagaaattgtcagcgaattggaaaagaaattagattaattgaagaagttaaagattgtactaggggttatcggggttattttagtaattggtgggggtttttacaaaataaaagaaaaccaagcaattcgtgcgattaaaacccaaaacaaacaggtatccaatcggattaatcaggacaaacctatctcatttttattattaggggctgatacgggttctgatgggcgtgtcgatcgcggcctctcggattcgatgatggtggttacgttaaatcctaaaactaagaaaaccttggtttattcaattccgcgggattcgctcgccgaaatggttggcagcaagactaagaatgttcaaaaaattaacgcggcctatgaattaggacaagcgaagatggctaaaaaaaccgtcagtgaatttatcggtgtgccaatcgattattcggtcacgattgatatgggcgcgctcaaagaactggttgatttcgtcgatggtgttgatgttaaaacaaatatcgatgtgagtttcgatgggcagacaatcaaaaagggccgccaccatttaaatggcaagcaggccctagtttatacacggatgagataccaagatccccgtggtgattatggtcgtcagttgcgccaacaagaagtcttgcgcggggtcgctgataagattcaaaagccccaatacttggtccatttatcaggtttaatgacaaaattaggcaagcacatcagtacggatttaacggctgatcaaacgaaaacgttaattgaaaattaccatcaatgtgggaccgacattacgagtggtcaaatcattgggaaagaagcctggattaacgggagttcttatcaagtgattgcgaccgataaattgcaagcaacgtctaacaaacttcgtgagagtctcgggttacaaaccaaaacgttaagtaacacagagactgaattgaatcaattaaacacggcgttctttaaagacaatactaataagacgtttaatactgatggcttaaatacgacttattattcagataatacgtattagttagcgtggaatcaattgataacgttggctagcgacaccgtcgataaaatcgcggtcatgttcgatgaacaagagtgttgggcgggtttggacaattaatgtttggagttgttcgcgcgtaatgacatctaggtagtttaacggttcgtcccagacataaaattgggcttcttcacaaagcgaacgagcgagggcggccttacgtttttgccccatactcatcgtttcaagccggtggttgaactgttcccgctcaaaacccagtttccgtaaagttgagagtaattgttctagtgataccttcctggcggctgcaaagtcagctagtgagccactgagctgtgtaaaatcttgtggtaaataagaaaccttgattcgcggcgcaatggtcaactgcccactgacttgatgctgcatttcaggaagtgcgagtaaggctttgataaaggttgattttcccgtaccgttagcgccggttaatgtgacttgttggccggcctttagttcaaatgatagcggctgatttagggcgcgaccatcttgttcaagtactaggtcggttgcggttaggacgatttgttgcggctttaaaggctgattgttaatcgtcagtggtgcggtaatttcaacgtttttgagcagaccttgtttttcagtagccgcttgttcactacgagcagtaatcgttgtggcgcgcttcattaccttagcggcgcggtgtccaatgaagcccttatcgagattggcactttcatttttgacactacccgcatttttaccacgttcagcctgttgggaccactgagatttttgttgggccgtttgattcaaccgcttgatttcacttttgagcaggctgttttgatgctgttcggattgggtttgttgttcctgagtggtctgccaggtttgataatcgccttgttggacggtaatatccgcccggttgattgataaaacgtgatcgataacttggtttaaaaagtgccggtcatggctgatgacgatgaaccctgttttttgttgtaaatagtgtgccacggtatcgcgaccatcttgatcgagatgattcgttggttcatcgatgagttgaaaatgatgctcgtcgatgaataataacgccaagagcgccttggtttgttcgccgggactcagcgtgttgaatggttgccagagacagtcgagatcaactttgagtaaattgagttctcgttcaatttgccaaaaggtgctgtcatctaattgaccgagcgtcattagaacgtcgcgggctaattgactcggatcagctacggtttgtgggaaatagtgaaaatctagatccgttttcagttgtccctcaaattctaattggcgttgaagtagttttaacagcgtcgttttgccccggccgttgcgcccgattaggcctaagcgccagctagcatcgaattgaagtgtgacgtctttgaaaaggggagttgcttgatctggatagttgaatgttaattgtttgaattggattgtgcccatatgggtttagggacaagattattcagaaaagagtcacttgagcggtatcttcaacaagatcaacgtttagctaaaacactaacggcgaaggatttaattgcgttaggcgtgggggcggtcattgggactgggatttttattttaccgggcacgattgccgcgctacatagtgggccggccattacgttgtcatttatgattgcggcagtggtctgcgcagtggccgcaatgtgttacgctgaattttcatcagcgttgccagtcgcggggagtgcgtattcttacggcaatattatttttggagaactgattggttggttgttaggttgggcattattcttggaatacatgttatcagtcgcggctgtttcaaccggttggtctgcatatttcgtctccttcattgaaggcttcggcgtgcatattccgaaggcgattacaggctcatttgatcccgcacatggcacttatatcaatttatttgcagtcttagttgtgacgctcatttcagtgttattgatgtctgggacgcgttcatcgacacgcatcaataatttgatggtgacgattaaaatcggcgttgtgctactattcttagtcgtcggcattttctatgtaaagtcgtctaattggcaaccattcatgccgtttggtgttagtggggtcttcaagggcgcatcattagtattcttcgcttatttaggctttgattgtgtctcggcttcagcggccgaagtaaaaaatccacaaaagaatttaccaattgggattatcgggaccttagtaatttgtacgttattatatattttagttgcttttgttttgactgggatggtgtcatatcgtgaattaaacgtggctaatccagtcgcttttgccttacaagtcgtgcatcaaaactggtttgcgggcttattatcacttggtgctttggctgggatgttcacaatgatgttgacgatgacttacagtagttcgcggctagtttattcaatcggccgggatggtttattacctaagatgctcggtaaaattgaaacacgccaccaaacaccagtcaacagtgtccgtgtagtgacagtgattatcgcgacactaggagggctcgtttcattagatcaattgacgaatctggtcaatattgggacgttaattgcctttttcttcatgtctattggggtgattccattgcgtaaaagaaaggatattccgaataaagacggtttcaaagtaccgctatatccttggttaccactattatcgggcttactttgtttattcatgttattcgaattaccggcagtcacttggatggcagcggggatctggttcattttgggcttgatcatttacttcagttacgggttaaaacacagtcggttaaatgattgagtgaaacataaacgcttatggctggcgctaggtagtttgttgatctgtatgattggggttttagcaacataccacgatgcgacgcgctacaaacaaccgttgatccaagtgacggctgtcaaaacgattcaaaaaacaaaaacaacggatgattaccagaatcaagataccgagatccagcaaaaagtaacggggcggttcttgaatacgaagcgcaaagggcagacgattcagctccaaaatacctattccaaatctctggccgatagttatcgttattatcggggccagcaagttttcttacaccatgatcaagaccgccatcaatggctcttaaacgaacctaagcgcgatacagtgctagtagctgtgatcctggggacctttagcttattacttgtgatgatgcttaaaaggggactgatgacgattttgagtgtcgtcgtgaacctcgtgttcttcattatcgcgcttcactttaacgctacaactggtggtcgttggttattgccgttgatgtgtggactcgccgtagttttaactggtttgacgttattgctggtactcgggccgaatcggcaaatggtggtgtcatttggtgcgacaattggggccacgttcttggcattactgttgagcgttatcctgttaaaaatcagtggcgaccaaggactccattacgaaacaatggattacgagctccaaccctacaagacggttttcttggcggaagtcgtgctaggaatattgggcgctgtcatggatgaggcgaccgatatttcatcgtcacttcaacagttagcttttgaacagcccaatgtgacgagacggcaactctttaactcagggttaacgattggtcgagaaattatcggtccacttgttaatgtcttgttcttcattgttatggcagaagcctttccgattattttattgtatctgagaaacgggaatacaattgcctatacactatcgcgcacgatgaccttgggcttcacacaaaccgtgattagcgcaatcggcattaccttggctgtgccggtgacaagcttgttggcaagccagttagtggaggtgcgccgcttatgaatgatgttattaacgggtgttttattactactattaatactagtgtgtggttggcaaggattaactatctttttcagcctggggttgaacttcgtcgttattattttagcgctggtcttgattgccgggggctttaatcccttagtggtcagcgggctattgagtctgatcttgttggcgacatcaatcttcatgaatactaagcaacctttaacggctaagacagcgtttgtgacgtcgttgttagtagtgctggcattgttagttatcattgtgccaatcagtcactggacggcaacctatggctttggggcagaggatgctgaagagattgaaggctttggtctggcaatcgggttatcatttccgcaagttggcatgatcatgacggttttagccagtttaggcgcaatcgcagaaacgagtattgcagttgccagtgggttggttgaaattttggaatatgatgaacagatggcaccggcacctttgtttaaagcgggaatcgcgattggtgagaaaattattgcgacagccttcaacacactgttctttagtttctttggaagcttcctatcattgacgatttggttcatccaattgggttatccgctcgctaaaatattaaatcataaaattttaattggtgagatattaacgttgctaatcggggtaattggcgtgatagcaaccgttcccatcaccagttggttattgaaccattttagaaagttaccaaaggcttaaatgtcacaaaacttacatgttagtgtttctggtaaccgtcgtcctatcaaccaaaagaatgctaaaaaacgtaatgctgaaacaacagctgtattgaacttcttgaaggaacgtaaatcagcaaaataattaaagtacgcgtactgcgaatgaaggcatgaagtaacttgagattgtaccaatcttaactgattcgccaggttgtggtgcgtgaacgtattggccaccaccgatgtagatagcatcatggtatgatgcaccagcgccaccccagaaaatgatatcgccaggttgtaagctgttaagtgatacgcgttgaccagcaccttcttgagcagttgtgatacggcccaatgaaacgccagcacgtgagtatgcatattgtactaaaccagaacagtcaagaccaacaccaggtgttgagccaccccatacataaggtgtaccgatttgtgataatgcagcactaacaactgattgtgcgttaccgcttgtagcagttgaattgtttgtgtttgttgattgtgaaggtgttgttgctgttgcgtttgagcttgaagctgtgttttgagtttgagtttgagttgttgattgttgttgagcaggagcactttgttgtgttgaagctgattgtgcagcaggtgctactgaagtgctagtttgtgatgtttgagtttgtgtttgaacttgtgttgcttggcttgttgatgatgaagtagcaactgatgattgttgttgagcaggagcagcaggcgttgttgatgattgtgaagctgcaggtgcttgttgtgttgttgatgtttgagcagctgattcagaagttgcagttgtagcagcaggagttgtcgtagttgttgaagctgctggtgttgttgttgcaactggtgtaacagctggtgcatcagtaataggtgtgacgccggctaagctagggttgtttaaaacaacgtagctagaaggtacccaacctttgttttctaattggtaccatgtaacgccattagctgttttagaagcaataacgttttgtgtcttaccataagttaagtaagcgccagttggttgagcagcagttgtgtttgtccagattgttgtagcaccagacttgtagttaactgtgatcgtgtctttagcagcaggagcagcagttgtagctgctggtgttgttgcgcctgttttgacgaattcgccggcaacccattcgttatcagctaattgataccatgtttgaccgtaaacttgttttgtatttttgattgtaacgttttggttgtttgttaagtaacgtgtaggtttttgaccaacttcaggacttgtccaaacagttgtagcaccgtctgcatagttaactgtccctgtagtagcagcttgagcttcattagcttggatacccattaatgcaagaccagctaaaccaacgataccagatgataaataagttaatttttgttttttcatttattgtaacaaaccgtcagattgcgattgcgttgtaatctgattatcacttgttgatgagtcggattgtgtaccgttcgtattattatcagtagcagcagtgccattattattgtcactgttagcaggcgtactgttttgagtattagtagctgagtaacttgtgttggttgttggtgttgtgggctgtgtgtagccattattagttgtcgtttggttgtttgtagcagccgtgttatcaactgtattatcggttgcctgtgttgtttgatcggtagcagttgtatcagttgatgaactgctttggctagtagccgttgatgattcgctagtattgtagctgtcaaattgggctttcgcttccttgatcagttttaagtagcgttctttgaatttcttgtgggttgttttttcaacaagtgctttagcgtaggtgaaatcttcagtcgttagggttgctggaatagcggtgtggttgctgtttgtaaagagattatcaacagcggtcatggctgcttgttgcgctttggcttctttataagccgctaattttttagcgtcattggcgtaatccgattctgcgccgagttgtaagccgtctttgacaatcccatcggcatcgaagaaatcgctatccttagttttcttggcttttttctcagttttttcgacgggggcatcagtatcaatgcgctttaagtccttttgagctgctttgaaggcggacttagatttgcttgataatgcgctcatatagagattatcagaaattttggcatctaattttttagcggatttgatgattttatgcttgttagtagcagttaattttgcaggttttttatggtctgcgtcggcgtaaagttggttgaccttttgaacatactgttcaatttgatcctcggttttagtagcggcggcagggaccgtcgttttattctgacaaccggctagaatcacgaaacaactagccatgagcatcaacagaacgtgtgttaattttttcatatggaatcagcttgtacaacaattttagttggtaaaaaagcatcacttgacggctcaacaatgattgcccgcaatgatgatacttttatgcccttaaccccccaacggttttacatgaatccggcagttaaaggccgtaagggtgaaaaaattaaatcttggttgaacggttttgaagcgactttaccagaagacggttaccgctggccagcggtgcccaatgtggattacaagaacaaaggttactatgacgaaagtagtattaatgaagttaacgttgcgatgagttgtactgaaagtacgtacggtaacgaaaagtcattggcctatgatccattggttaaagatggtttagacgaagattgtatgcaagcaatggtcgcaccttatatcaactcagctcgcgaaggggttagctacctcggtaacttaatcaaacaatatggttcacctgcaggcaatagcgttttgttcagtgatcacgatgaagtttggtatatggaaattgttaccggtcatctttggctagcacaacggattccagatgatggttatgctgtagcggcaaaccaagtggcgattcaacaagttgattttaacgatactgataacttcatgtgggctgaagggattcaagaatatgttgaaaaacatcatttgaatccagataagacaggctggaacttccgccatatcttcggcacaatgaacgaaaaagatcgtcactacaacacacctcgtgtttggtacgcacaccacttatttgatgctgaatttgacatgtcacctgaatcagctgatttacctttcattcgcaagattgaacataagattagtgttgaagacattgaaatgttgcttggctcacattataacgaaactgaattcgatccaatgggccacggcgcagatgctgacaagtatcgctatcgtccaattggtttaaacagaacacaaaatgcgcatatcttacaattgcgcaacgacgtgcctaaagaacaagctgccattatgtggattactttaggaatgccaacttacacaccatttattccattctttacgaatgctaatgatacagatcctagcttcagtgaaacaccaatgaaatgggatattaacagtgcttattggatgtaccggacaatttcagtcttggttgaaggccattacagccaacacattcaaggcaacgttgattatctaacaagctgtaaacaagaattacggacaatgttggatagtattgaagaagaagctaagaattaccaaggcgaagcccttacaaaatatttaacagaaaaaaattatttgattgttaaaactatgaaagataaggccatgggcatgattggcgaactcgtcatgtcaggaattaatttatctaaattgacattcaatatggatcgcaacctctaaatgtcatcaaagattacggggaaatattctgaagactgggaagttatcacccatctatcactcatttatcgttgggttatcagcaatcttagcgattttgttagtggggaaagtttgaattataaagtatcatttgatcaattcttgattatgtatgaaatcgccactaacgacgatttaacgggtagcaaattagctaaaacaatgagtgttagtcgttctgcaatctcacgtcaatgtcgcttacttaaagaaaacggctacgtggttgaagaacatttacaatcagatcaacgggttaaattcttgagtttaactaaacaaggacaagatgttttagatcgcttagttagtcgttatctacaaaagtatcaagaaatcgaaacacaaatgggtcgggaaaaaatcgatggcttaattcaatttatcgaccaattctatttagacgttattgaacctagtgattatcacgataataaaatgggccgttcattcttagaaaaagtccaacaaatccaatcagacgaccaaattgccaaataaatggaaaaaattctagcaattaacgcgggcagctcaacactaaaatggcaattatttgaaatgcccagtgaaacagttatcgccaaagggatgatcgatcgcttaggtttatctgattcggtgtttaccgctaaatatggtgacaatcaaaagtttaaagaagttcaagatgtaaccactcatgaaatggcagcaacgcttttactcacacgtttgaaggaattagggattgttagtcatttggatgaaattaccggtgttggccaccgagtagttgggggcggtgaagctttcagtgattcaatggttattaatccggtggcattggacgagattaatcgcttggcagaatacgcgccattgcataaccccacacaagcttattacatcaagatctttacggcgctactaccaggtgtgccccaagtagcggtttttgacacctctttttacagtaccttggcacccgaaaattatttatacagtattccgcaagaatattatcaaacatttggcgcaagaaaatacggcgctcatgggaccagtcatcgatatgtcgcccatcgagccgctgaaatcttaggaacaccgctagaatctcaaaaaatgattacgctccatttagggagtggggcatcaattaccgcggtccaagatggtcatgccgttgatacttcaatgggttttaccccactggctgggattacaatgggcacacgttctggcgatattgacgtttctttagttgctttcttagcaaaaaaattagaaattacaatgcctgaaatgatcgatattttaaatcacaaatcaggtttgttaggtatttcagaactctcaccagatatgcgtgatttggaagaaaccgccgctacacggccacaatcagcgttggcattatcaatctttgtcaatcgcgtcgttaaatatgtgggttcatatgtggccttaatgaacggaatcgatacgttagttttcacagccggtagtggtgaaaacgggagtgaattacgggcagatatttgtaaacaacttgcttgttttggtgtaaaattggatgaagagaaaaataatgtccgcagccaagaacggattattagtgctgatgattcgaaggtcaaagttttaattgtcccaacgaatgaagaattaatgattgccagagatgtcatgcggttaaaataaatggcgcaaaaaccattatttgaatttgaagttgatattccaagattaagtgcgcgacttgaggaccagccagccgtgaaaacttttttcgaggccttaacccccgggtatcaacgggaatgggcgcgctatgtttacggcgctaaggctgaagaaacacaacaacgacattatgctgatatgctgatgattttagaagctggttacaaatcaaaacgcgggtattcacaagctaagaaaaaataaatgatgaacgctgtaaatatcttaatcggcttaatgccgatgattggctgggggattttcccagttattgttggtaaaattggtggtaaaccagcgagtcaaatcctggggaccacttttgggacattaattctagcaattgtcgttgccattttccgtgggacaccaattcctgaaacgaaaactttcattttctgtttgatttcaggtgcatgttgggcactggcacaaattattactttccacgttttcgaaacaatgggtgtttctagaacaatgccgatcacaactggctttcaattagttggggcatctttgtggggagtcttcgttctaggtaactggtcaagttcacaatcaaaattaatcggttttacagcgattgcattaattatcatcggcgtttatctcaccgcttggagcgaagataaatcaagtgctagcaagagtggtgcggttaagggcatcttgttattattagtcggtgaattaggctacttaggttattcagcctttccacaagcagttagcgctgatggtttccaaggcttcttaccacaagctattgggatgacaattgtcggcattatcttcggcttaacccaaactaaaaaagattataaaccatttaaagaagcaacttcatataagaacatcttcagtgggttcttcttcgcttttgcggcattaacttacttgatttcagcacaaccatctgtcaacggtttagcaaccggtttcgttctatcacaaaccagtgttatctttgcgacaattggtgggatttacatcttaaaagaaaagaaatcaaaaaaagaaatgatcgccgtaatggttggtttattattagtcttggtggcaggttctgtcacagcatttattaaataaatgagaaaaactaaggtgattaacacacaaatttcgagcgttatttcagatatgggacatttcgatacattaagtattggggatgctggtatgccagtaccagctggtacgaagaagattgatgtggccattgaaaatggtgtaccgagttttatccaagttttaacaaatatcttaagtgaattagaagtgcaaaaagtttacttagcaaatgaaattaaaacagcaaatccagaacaattagcggcgattaaagctttaattggggagacaccaatcgaatttattgatcattcacaaatgaaacaagacttaaataaggccaaagcatttgtcagaacaggtgaaatgacaccttattccaacattattttagaaagtggcgttgtcttttaaatgaaaaaagtaatcgtattaggttcaaccaatgtcgacacaattttaaacgttcaacgttttccacaacctggcgaaacgttagcaatggatggccgcgcagttgctggtggcggtaaaggtgctaaccaagcaatcgcagctgttcgttcaggtgcccaaacagctttcattagtaaggttggtaaagaaggtgccgctgatttcatgatcgacacgttcaaaaaagacgggatgaacgttgatcacgtgcgctgttcagaaacagctgggacaggccaagcttatatcatggttgatgctcaaggtcaaaacagtattttaatttacggtggcgctaaccaagacgtgactgttgaagatgttcacgaagcagaaacagccattaaagcagccgaccgaattgtggcgcaattcgaagtaccgatccctgccattatcgaagctttcaagattgcccgtgcaaacggcgttcaaacaattttgaacccagcacctgccatcaagaatattccagccgaattattagcagtgacggacatgattgtccctaacgaaactgaagcagaaattatcactggcattaaagtgactgacgaagcttcaatgcaagccaacgctgaagcaatgttcaaattagggatcaaagtggtcattatcacggttggttctaaagggtcattctatgcaacaccaactgcaactggttttgtccctgcctttaaggttaacgcagtggatacaacagctgctggtgatactttcatcggtgcgttaagtacaaaacttgaattggattacagcaatatcgaagctgcgatgacttatgccaataaggcgtcatcaattgccgtgcaaactaaaggtgcacaaaattcaattccatatgaaaaggatattcagttataagtggtacgaaaagtaacgattaaagatgtcgctgccttggcccaaacatcggtgacaactgtttcactaattttaaataataagggccaacgctttagtgcagagacgattgcccgggtaagagcagcgcgtgaaaaaatcagctatgaaccggattattttgcccagaatatggtcaataaggaaaccaaaacaattgcggttttagtaccggatatcaataatcctttttttagtcagtttattcaaggggttgaagaagtcgcctatcagtacgattttattccgttgatttatagtgcgggccagaataatcagaaagttaattattatctgaaagagctggtccgacgaaatgtcgatgggtttattttggcggtttcacatattgaagaagaaacgctagagggccacttgaaacaacgtaaaataccgtatattctgttagatcaatcggaaaagcaacatcaaagtgatgaaatcgctgtggcggatacggaaggcggccgaatggcggctaattatctgattgaaaaagggcaccgtcaaattgggatcgtgttgccagaacagcgggcttggaatatcgagcagcgttttattgggtaccaagcagccttggttagtcatcaaatcacggttaatccggattggcaaataacgacccccttatctaaacagggaggctatcaagttgcccagcaggtgattgatagtggggtctctgcggtctttgccgtcaatgatgagttggcgattggcttagcacgggggttagccgaattaggtcatgcggtaccagagtcaatttcgattattggttacgatgatattgattggtgtgaatacgtcacaccgcgactaaccactattaaacaaccgattttggcgttgggccaagaagcgacccgcttgttgttaaatcggattgaaaaacccacgttagggatgcaacaaaaaatgttatcagttgaattggttgaacgagatagtgttcaagcgcaataaatgtatgaattgctgatgttatcagccttaatgagtcggaatatgtcgggctataagttgcggattatcttggaaaatgccatgctgcccagacggaaaatctcaaatggggttttgtatccgttgttagataaattggaaaacaaaggctgcattggttttgatgaagctgatcaggattcacggggcacaaagattgcgcacatcacggaagaaggccggcgctattttgctgaattaatgactaaaccagtcgctcatgatgcgaagtgggatgacgcttatcgctttaagatgcgcgggatgcactatatcgattccgaagaacaaatcagcattttacaagactaccgcaatgagttagctgaagatttacacgtctatctgggtatcaaaaaccatctaacagatttgcgggatgaagaggggaccaatactaattattatcagtggcaggttcgttcaatggattttgtaatcaccacgcttaaagcaaaggtcgactggctcgaagcccaaataaaagagatcgagaaaatggagatagtaaaatgaatgaaaaaaacaacaaatcgttggatagcgctggtcgctatgagcctaggggtctttatggggctactagatgtcaccgtcgttaatgtggctttgcccagtatggcggttgattttaaaaccactttcagtaacttacaatgggtattgaacgcctacacgttaatgtatgcggtcagtttgttaattgtttccaaattaggggacatgttcgggcgcaagaaaatttttattatgagtatgattttattcacggccgcttctgtcgttaacggactggcaccaaacttattggtattggatattggtcgtgcaattcaagcaattggtggctctgggatgatgagtttatcgatggcgctagtggcatcgaactttgaagggcgtgaacggggaacagcactggggattttaggctccgtcattggtttttcaactgccatcggacctttggtgggtggctttttagtcgaaagtttcggttggccatcaattttcttcgtcaacttaccagttgggattatttcggtttacttagtgattcggaatgttaaagaaacaccagcatatggtgcaggcgaatcaatcgattttatggggatgtttttatcagcaattggtttattctccgggatttatggcttaattcaaaaagaacaacacatgcactgggcttggaccgacatgcggattatggggtggttagtcgcttccgttttgattctagcgctcttcgtttttgtggaattgaaagccaaagcaccaatgatgaacttgacgttacttacaaatcgccatttcgtgggtgttgtgattttggccttctcattaggggctgggatctttgccttagccgcttatcaaacgagtttgatgcaaaattatatgggatattcagccttttcaactggggtccatcaattgccaatgagtctatggtcacttgtcttgggaccattcaccggggtattaggttataaatttggtaaaaaatggctgattgcttttgggtttacagtctcggcactcggtttattaatctttagacaagtgaccacgaccgattttacttacatgcaattattaccgttgcttgcgctaactgggttagggaatgcgattatcaatccaatgatcaatacagcggcgatggacaatattaatcctcaagaaatcggaatggcctccggtttgttgaacgttttccgtcaaattgggattaccgtgggggtcgtgattctcggattgtcacaaacaaacgcctatgagagtagcttaagtactggctttagtgggagttcaatcccaaaggcggcagcaactgggattcaccaatcattagtcgaagcgggtgctttttcagggcatgcaatcgcatgggggcagcaattagtgaagacgccgtatgctgccaaggtgcaacaaatggtggtcacagcttttgataaagggatgattgctgtggtcacgacgtccttagttttaatggtgattgccattttagcagcacttttcttattaaaagaaacaaaaagtgtcgatcaaaaaccccaaaaataaatggctaaattagtttttattcgtcacggacaaagtgaatggaacttatcaaaccaattcactggttgggttgatgttaacttaagcgaagaaggcgtacgccaagctcaaaacgctggtgctttattgaaaaaagaaggcatcctttttgaccaagcttacacatcagtattgactcgtgccatcaagacattacactatgcacttgaaggttcagaccaattatggattcctgaaacaaaatcatggcgtttaaacgaacgtcattatggtgcattacaaggccaaaacaaagctgaagcagctgaaaaatggggcgacgaacaagttcacatctggcgtcgttcatacgatacacttcctccactattggatgcaagtgatgaaggttcagcagcaaacgaccgtcgttacgcacacttagatccaaaagcgattcctggtggcgaaaacttgaaggttactttggaacgtgttatcccattctgggaagacgaaatcgctccaaaattaatcgacggccaaaacatcattgttgcagctcacggtaactcactacgcgccttaacaaaatacatcgaaaacatctctgatgaagacatcatggacgttgaaatggcaacaggcgaaccagttgtttatgatttagatgaaaacttaaacgtagtaagcaagaagaaattaaactaaatggcaaatatgtacggaaatgatcctttttttaataatgatatggatgatatcttcaatcaagttttcagaagaatgggtaattcagagtcagcgcgatatgtgattaacggacgagaattatcaccggatgagtttgctcagtatcgggcaactggtaaattacctaatcgagaaaaagaaattgaaattaagcaaaatggtgaacatgcccttaaaaaaggtggcattcttgaaaaattaggtcgaaacttaacccaagaagcacgggatggtttattagatcctgtgattggccggtataatgaaattcaagaaacagctgaaatattgagtcgccggactaaaaataatcccattctagttggggatgcaggtgttgggaagaccgcagtggttgaaggattagcacaagaaattgtggctgggaaagtacccgaagccattaaggataaagaaatctattcaatcgatttgtcctcactagaagctgggacacaatatcgtggttcatttgaagaaaatattaaaaatttaattaaagaagtaaaagcagccggcaatgttattctctttttcgacgaaattcatcaaattttagggattggttcaactggtggcgaagatggcggcaaagggttagccgatattatcaagccagctttatcacgtggtgagttgacggtcatcggtgcgacaacccaagatgaatatcgcaacacaattttgaaaaatgccgcattagcaagacgatttaacgatgtgctggtcaatgaacctagcgcagcagatacggttaaaatcttacaggggattaaaggcttgtatgaaaaacaccatcacattgaactaccagatgacgttttgaaggcggccgttgactattctgctcaatatattccacaacggacgttgcctgacaaggcaatcgatttattagatatgactgcggctcatttagcagctaaacgcccagaaacagataaagctaaattggcggctgaacttaaacaattagaagctgataaagccgcagctgtcgaagctgaaaattatcaagctgctgaagagctaaaagttaaaattgaaaaaattaaagcgcaattggcaaccgatgatcagcatgcggcagaagtgattgcgactgttgatgatattgcacaatctgttgaaagattaactgggattcccgttgccaaaatggggagcaatgatattcaacgcttgaagaacttaggccaacgcttaaaagataaggtcattggtcaagatgaagctgttgaaatggtagcgcgggctattcgcagaaatcgggcaggtttttcggaaggtaatcaaccaattgggagcttcttatttgttggtccaactggggttgggaaaactgaattagcaaaacaattagccttagatatgtttggtaacaaagaagcgattatccgtttggatatgagtgaatatgctgaccggacagccgtttctaaattgattgggacgacagccggttatgttggctatgacgataattcgaatacattaaccgaacgcgttcgtcgtaacccatattcaattgtcttgtttgatgaaattgaaaaagctgatccacaagttttaacattattactacaagtgatggacgatggtcgcttaacggatggtcaagggaacgtgatcgactttaagaacacggtgattatcgcgacatctaatgccggttttggtaatgaaaaattaaccatgaacgaccaagaagatgctaagttattagataagttagcaccatacttcagaccagaattcttaaaccggtttaacgggattgttgaatttacgcatttaacgaaagctgacttgtcacaaattgtggatttaatgttaaccaacgttgaacaaacattagctaaaaaagaattaaccttagttgtttcaaaagaagctaaggattggttgatggaagaaggctacgatgaggcaatgggggctcgtccattaagacgggttattgaacaacaaatcagagataaggtcactgatttttacctcgatcatgcagatgtcaaagacttaaaggcagatttagttgatgatcagattgtcattcaagcggtcgactctgaaaactaaatgttatcaaagaatatttcgaataagttacgccaagcaactggtgtgaatggcttattgtccttaatattgggtctattaatcctgtttttacccgggcaatcagccatgggtgtcacggtgatggtaggtgttgtttttatcattatcggtctgttcgacatcctttctatttttaaagaagttgatgaaaatacatgggttcgactagggcacttgctcttaggccttttgtatctcattgttgggatctttgtatgcgttaatttagctgctagcgcaacctacttattcctactagtcgggatttttgtaggaatcacgtggttggtagaaggctttgtggaattgggaacagtgcgcttagcagtttctaagggttggacgatattctctgcggtcttgagtattgttgcagggataattcttctgatgacaccgctctacggggcagttatgctgtggaccttattaggcgcaattctagtggttctcggtatctttaaagttgcgcattacttagcttggcaaaaataattataggtcatcgagttgtgctaattggtagcccatcaacatcaatatcagttgtagaattgaaaatgcgatcacgaaaatccaaaaatcagattggttcaaaacaccgagaacgctcgcgattgttgtgtggagttggtagaaaacatcccacgagttgattcgtaaaaagcgcccgatataaatggcgactgaggaacaaacacttaaaacaccgaaggtcgctgcttgattaacgaggcgttgatagttggggataaagagtggataaaggatgaataaactcgtcagccctaaggtgacaccgacaaaaatcccgccggctaaaatcgcgtattccacaaattggaaggcggtgctcaagccaacaccaattgatgagaggtgactgaagtcggtaatcatgtagagtgcgttggggaaaaagagtagccaaactactccgattaagtagcgccaacgactatttttgaataagcgccccagtaaactcagatcaaacggtattagggctaaaatgatgttccaaattaagaaggcaaaccgactttgatagagtaaaattaacgcgaaaaagagcaggataatagcatgaatcgtcagaacttttttggacaaatgtgtacaagtctcacttattcaaccgttgacgggcatcattttttagcaagaaccatggatttttcatttgaattaaatggtaatccgctctttttaccgcgccaacatcaatggcaaccggttttggaaaagcaagcgattcaaaatcaatacgcgttgatgggggccggtgctaagttgggtgatcaatatctagtagccgatggttttaatgaacatggcttaggctgtgctgagttatatttcgcgcacgccgcagtttacgagccacaaccagtacctaataaattgaatttggtggctgaagaatttatcgtgtgggttttgggaaactatcaaactttagaagaagtggctgcggatttagacaacgtgcggattatcgaaagcgaccaaggtgtaatgggcgcgaaccaaccactacattggatattatcggatcgttccggtaaaacaatggtgattgaaccccgcggcaatgggcttcagttaattgatgatccggttggggtgatgactaatacgccggatttagactggcacattaagaatttgagtaattatttgaatttacaaccacaaccctttatggagcggccttttggtaattatcaagcaggtccttttagccaagggacggggacccaggcgttacccggaagttatacgccaccagatcggtttgtccgggctgcctatagtcggcaatatatgccagaagccaataacgtggccgaaggggttaatcatattttgcatatcttagataatgtcacaattccaaagggtgttaatattggttcgggtggtagttcagattatacgcaatatcaaggcatcagcgggctcaacaacttggcttattatatggtcaattacgataatcgtcatgtttatcaaaccaatttaacaactgacctcattgagaatcaaaaggaaccagtaatatatcatttaccgcaaggtcagcaaaataccatccttaactaaatgaaagttgttcaggattatctgacttcctccataggatacagattaattgctaggaaatacggtattaaaagttcttcatctgttcttttttggattcgacgttatgagacctttggtctaaaggggctcgatgtcctatcacctgataaaatatttgatggctcatttaagatgaatgttttaaaatggatgaaaacgaataaggcttcttatccgaaaaccgcacttcattttaatatctcaaacgtcgggaccatctggcaatggcaacatatttgggagactgagggtgctgatgccttatatcgttccaaaggacggcaaacaattatgacagctgataaacaatcgaaaaaacggcagcaaacagaactagaacgtctgagagaagaaaatgaattactacaaatcgagaatgaatacctaaaaaaattaagagccttagttcaggaagaagaagacaacaagcgcaagtcatccaagagctaaatggctaaaagtacgtatgaatacattattagccatgaaccgaacggttcatctgaccaatctgttaaacaagccatccaaacaatcaagaagaatcatccagcgtacggttatcgtcgtgtaactggtgaattacatcgtatgaatatcttagtaaatcataaaaaagtgcttgtcttaatgcgagaactacaattactatcaactgcatttaacaaacgtactcgtaagtataattcatatagaggtaatgttgggaccgttgctaagaacttaatccaccgtcgtttcttcactgatcgtccctatcaaaaactagtgacagatgttactgaagttcgctggggaaccaagacaattgacgaacgtgcctatttcacatgtatttatgatttattctcaggtgaaattcttagccatcaagttagcagacaccctactgttgaatttacaacaactgttttaaatcgagcagttaagaaaatccctaagaatttaaaataccggacaacagtccactcagatcaagggtttcaataccagcatcaagattggactaatatcttgaaagaacatcgcatttttcaaagtatgtctcgaaaagcaacatgtttagataatgcatcaatggagagctttttccatattatgaaagccgaagctttctaccaaaaagaaaccgatacttatgaaacgctagtttcacaaatatcggtttggattgatgattataatttttcaagaattaaaacaaaactgggttgtaaaagtccggttgaataccgaatttttacaacccagaaagctgcttaattgaggctatttaaattatgcatgactttattattaatggtaaacatgttagcgagttcggtaatgacgactgaagtaaatgctgttgaagcgcctgctaatgcgtcttcggaaacgatcactaaaatagctcaggacgctatttcaggttcaacaccaactaaacaatcaaatagtgtcattcaaaaaaaggcggcttcagatgcggaaacacaaactataacgccagcaacgtcaggtgaaaaagcgacgctacttgaagcaccgcagactaaaaaaactagccaaccccaaaagcagcaacttgatcaacgagcaggcaccagtttgggaacagtcacctggtatatcgatgatacaacggcgaccttacatttatcaggcggtgtattgccagataaggtggctaatgataatactaatacaccttggtatttccctaattcgccttatattgcgcggattgcgcatatcagcattgatggtgaaattacagctaaagatgtctcctatatattttgggggttgaccaacttaacaacggttcaggggttagctaatctaaaaggggccactaattttacgatgttatttgccagtgacagtgcgctgcaatcagttgacgcgactaacttagatttttcaaaagtgacagcaatgaattcgatgtttagtgattgtgccaacctagtatctgttggcgacacagcgaattggcagcttgggcaagtcaccacaatggtaagatgcttcagtggtgataaaaaattaagtcagctaaatagtacgaattgggacacttctaatattcaaaatatgaataacacatttttcaattgtacggccttaacgaacttagatgtttcaaaatggcagacggcaaaaatgactaatctggggagtaccttttcacaatcgggcattactgttttagatgtttcaaattgggataccagtcacgttactaatttaagtagtacttttctgaatactagtattgccgaattagatgtttcgaattgggatacaagccaagtgacgacaatggcttatactttttcgggatgttcaagacttgaaaccttagatgtctcaaaatggcagctcggcaaaaatacatcgttgtcttacacgttcagcggtgatcaaagattaacgcagttagacgtttctaagtggcaaaccgctaatgtgacgaatatggcttcaacattttccgggactgtcggtgttaagactttagcggttaaagattggcagaccactaaagtgacaaccatggcgggcatgtttgccaagagtggcgttgatcagttagaaattgctgattgggatacgagcaacgtccaaagtatgcgactcatgtttgatgcgacgaagttaacaacgcttgattatcctgattggaataccgctagtgtaaccgatatgagttatatgctgcgtgggatgacgaaattaacggatgcttatttcacgaattgggatacgagtcaggtaacgaatatgggcggcatgtttttgaatgatcaacaattagcgcacctgcggttgggacccaaatttaaattcttaacgagtgcctcaactggaccatcattagcagaacccagcactgaaacaccctattttgggaagtggcaacgacatgatgcaaatgataatcaagttgggaatacctatacatcagcagcattaatggcccagtacgatgggacgactgttccaactggtgattattattgggccgtcgcaacacccccaacgattaccaagttggtacgtaatgtgacagctgatggtaataatgccccatttaagacggcaacaacggctcaaaagggtgacacagttgattaccaagtcaatatcacccagccaagtggtcagcaattagatcggggtgcggtctttgaagatgtacttgattcacatttgaaatttaataataataaggaactatcaatttcatattctgatgaaaatggtgattttcatggagaacagctcattaaatttaacgatcaatggcagattgcactcggcgaaaatttagcaatcggacaaaaagcacaagtcctaattaaggcgattgtcaacgacgatagtgcgccagaaatcgataatcttttcaaattggtttctggaagttacggtgccggtaccacttcaaacactgctatcgtacacgtcaagaaaccattgacgttaaccgaagcgataaaaaatgaaacgacggatacggattgggacaccaaacaggatgtgagtccgggtgatcgagtcggctttaagctcgattatcaaaacacgacgggcgccactagcaaccagataacgtgagtgagtcaaccagttacctcgaatacagttgatatgaacgtggtccaatcagagcatcaattaaccattcggtatgttgatttagatgaggatcttagccagcctgctagtgcggggactcaaattgccgcgccgattacggtgtctggtaaaactggcacagctttatcaacccttttaccagggcagcaagtcgcccctaaggtgattgagggttacacgatttattcagtcagtgaagatccagatttaaaaccggagaattggcaaaaagcgtatcgcgatgatcctcaaattggcgaccaagatcgaatcattacttacggttataaaaaggcaatgttatcgattgatgcacctagcagttgggaatttggtgattataataataaacccatggaccggacgtattatttaaatcataatcagggcacgccacaagcagtgacggtcaccgataattatggcgttcaaaattggcaattacaggttagccaagcaaaaccgtttgttgatagtgaacaacatgagttaaccgatgcaaaatgggccttttcaaatggcaacgttaagacgttatcgaacaccgatgtggggactgtcactaataatagtgagcacttcacattggcatcaggccagagtgccactttaatgacgatgactaagagtggtcatttccaatccgattcaccggataccagtgatcccgaaaatccctatacccaagttggacaagggcagtgggcttatcgctttggtgacgaaaaaagtgccgattatagtattggtttaaatgtaccggcaactactaaacgatataccggtcattatcgaacgaaattgacgtggtcactatcagttggcccatagatgcgattaagaaaatggacaacagggttagcagttgggctgttcggctggctattattggctagcaaccagccggtttcagcagcacaggaacatatcgattttgaagttgaaaaagttaaatcgaaccgccaagtggatcaagaaaatcgcttttttgatttaggaattgaaccgggtaaaaaagaaaccattcaggttttggttcataatttcagtgataaaaatattaaagttcattcagagattgataatagtttgacgcaacaaggtggggggattatttatcgccctacgaaagatggcattatcaaagaaacatcgcatacattgatggatgttgctaaagttcatcgggccgatcgagtgattacgctaggccctaatgaggtcaaaaaggtcagtgcgacgattacgatgccatctgaacaaaccaaagggatgatttacggcgcttggcattttattgaatacggtcaaaaagaaactgacaatcattcgaatgtctccgggagttatgcctacaatatggggatcgttttgcgcggtaagccttacgagatttacccagagttgaaatatcaaggggttaacccaaccgtcagaaacgggcatccagcgttagggattcagttgaataatacgaaaccaatggccatcaagaatgccaaggtgaaggcggtcgtttacaagaatggcttctttaaagacaagcgtgtttatgaaacagacagcgttgatgttgcacctaattcgcagtggactgtgccaatctcatgggcgttcgatcgattgaaacccggtcgttataacatttccatcagtgttaaaggtaatagttattggaaccaattaccaatgagctggcactttagaaagaaaatcacgatcaatcaacaacaagccgataagattaatcaagcatcagtgaagaaacccgttaataaatgggcgtatgtcgcgactgctagtggcattttgatgcttgtttcattctggtttgtttatcgggtattgaaattaacaagggggctttaaatgaaattcacaaaattaacaagcacagttttaacagcatcaacattattagcaattctagcacctgcaactatcgctagtgctgcaacaccaaaagacgatgcagcagctaatggtggtactaagttaccaatgactgacacaacagatgctggcatttcatttggtgatacacatgataacggcaattcaggctacttaagattacaaatggtaccaaagacattagattttgggaaccatgctaagtatgacgcagcacacacaaactttgatgcaacgggcgctaatttaggcgttgttggtaatgatacacacgcttcatacgatcaacaagatagcaataaaacagaaatattaacaacgagtgacgctaatttaaaggccgttcaagggacagcttgggcaacagttgttgataaacaagttgaaaacccagaattagcagctgctacaccaaaggctaatacagctggtgactggaagttaactgtttcagctgatggcgatggtctaaaagctggcggacacacaattgcagacgctaacttagtatttggtaatacaaaatacggtcggacagctgatatctatggtttaacaaaccaagatcaagataatgatggttatacagcgctgggacaacagatgcaacatacgcaaaatcagttagcttgattgaacttgagtacaccaaatgaagaaaaagtggttggaacagctgctaaagatgctggcgatggcgctaacgtctttggttggaacccaagcgatattcgtttagctttaaacggttcaaacgatgtggcaactggtgaatatcacgctggtttaacatggacattaaacacaacaatctaaatgtttaaacgtttgaatatgttgtggttttgcttgatcttagtggatttattaaccgttcaaacgagtaatccagtcttcgctaagagtgaggggttagctattcctgctgagcccaaggcgacgttcatgttaagacctgaattaccgaaggataatctgggttgtaagcgtttagggtactttaatctaaaattgaagcgtgggcaacaacgcaccgtatttttaaaagtctttaacccaaccgcccaaccgttgacgatttatggtcgcgtcaaagatgcgacaactaatgataatgcgacagttgattatctgggggccaacccgattgatcggcagttattaaaacaaccggggagtcaattagttaaagtaccacgagcaacaaaattacaaccaaacgaaacaaaacgattaaaggttacaattcaagctcctgccaaaggttttaaagggcaaaaagcgacggcgattaatttaagcaccaatcagttggctaaacataatgctgttgaaaatcattatgtttacgcgattaccttaatcttaaatggacgataagtgaagcaaaagcgggcagcaattagtgttgcgattgctaatcccaatccagcttatctgaagtcggcgaccgttaaagttgatttacaaaaccaacagtggtcattgattcgttatcaggatcagaaatcaaatcgtaaaattgccccgaattctcgcttctatgaagatgtcccactaggtggcaagcggttagtagcgggtgtttatcggatgacgctaacaattaaaacggcgcatcagcaacagattattcataagaatatcgcaattagtaagggccaggcccgctacatcaaccaaaataacgatcaatatttgaagtatcgcaatctcctattattgggtggttttgtgatggtcttaatgggcgttattggcgggtatcggattttgaaggtaaagcatatgaagagagatgagcacgatgattaaatgattaagagtgaaaaaaatcaatatttagaaggttaccaattattaacaaggttagaaaatggcttggatacaattgcgaaacggcatggtgtgagctttagccaatacttaattttgaaacaaattgttgaaaatgattgtaatgaaccatcattgttagcaaaggcctttgccatttcacggcccgcgatgtctcgtaagctaacggttctgtttcggaatggcaagattaaaaaattatataacctaaaagatgaagatcaacgtataacgagtttgtagttgaatcgggaaaaagggtttagaaaagtgttactgtttggactagccttatatgtcgttggattcggcttaggacaagatgtgacgcatagttatgcgactgaagctagcagtgatgcgacactcaccagtcagttaagtagtgattcggagagcacatccagtcaatcatcgagcgaaacgctcgcttcggaaacgcctaagattgcgcctgaaacaaaaggcgagtcgaccaatccagttaaagttatgccatcattggctaagacacaaacaccagtgacacaaaaggtagcgcgcgcagcaacgacctataaaatccaagatttgattgatcaagggggcgttaaaacgactgtcacctgggatatttatagtcagtcagaagacgatatctctcagggctatacaggaacctattatcctaaagtaattaaattctcggtattacctaataatgtgctacaacctggtgataccatcagtttcagtgtgcttagatatactggaaaattaagtggtcagggaccggttacgatggccagcgtctcactcagggaattaggccaatatgacggtaagtcgttggtactgggcagtgaatatgttcccgataaagcggtcgatgcgtcgagtgacttgcctaagagttcgggtggggtggcaactttaacgaatgaaacaacgcctgattacacggcggcttatgccggcagtacgattaatgggacgaaatcatcagtgacggtcattccggccacgcattttaatggttttcaagtgactaatgcggcagttggttctgacaaaaaaggaacattaaccttaagtggttatacaaaagaccaaacctacttccagtcagccttagatggcacgcctaaccttaagggcgtgccaacggctaattatgtccgaatttatcgcattgataaagagtcagcacaaaatattaataaagttagctttgatttaaaaacttacatgccagcgttaatgccggatgggcaacatatggctgccaaagcggggacaactgggccgatgctcttcattaaagcccccgcagctgtgccgattaataacagcggcagtgtcgccgccgatgcgactgacgatgagattatcgctaaaacatcgccgcaaacctatggtgttttgcataattcggatggcagtatgaccctttacttgaactatggcaatttgacacggccttatgagttaccggtcgatacgattaccaaaggggttatgaataattcttgggatgggacccaagagggattagattacgcgctcaaccggctatcgaataacaattattcggccttagcgacttcaacttatttcacaatgaatattagttttaatgatccaagtatcgaaaatacggtccaagcaacgtacaaagatacacttaataatacagaaacgattaaccaaccatcatcaccacccagtgcttcaacagatgggcaaaccacaatcaaggtgcattatgctgatcaaaatggtaaatacatcaaaccaattgaaactcattatggttggcctgatacagataaattacaaatcacaacgcaagatttaacaattccggggtatacgttagataagtcgaatctacccaaaggcgctgatccagatactggtgcgctcactttaagttatcccaaagaagcaggtaaagttgatgatattttgtatcgctttatccaaaataaacaaaaaattgacgtgacctatgtcgacgacacaacagggaagcaattagcgaccgatacgatgtcgggtgttgttgatgaaaattcaaaatacaatacacaaacgaaattagcagcgtatgaaaaacagggttatcaattagtgagtgatgaaaccaatggcgcaacactgctttttagcgaccaagattaggtgcacttaaaacatgcgattaaagcggcaccggatgaaagcaagcaagtcaaacgaacgattcattatcgctatcaatctaataagcaagcagcaccggatgtggtcgataaaataacctttacaagacatgaccagattgatcaagtcaccaaccaatcgattggctttacgaagtgggtctcaacagaagggacaacgacgtttgcaaaacagacgagtccggtgattaaaggttataccgctgatcaattaactgttccggcggttgaaaatattactcaagactcagccgatattacggcgacggtcacttacacaggacaagcgcaaaaagccacggttacttatcaacgaagcgataatcaggccgtcattcaagccgatcaattaaccggcgtcagtggccaaatcagtgattatcgaaccgacgctactttagcagccttagcggataagggctataccgttgccgataatccatatccgagcgatggcttagtatttgatgatgatgtggctgtcgatcagaacgtgacggtgttactgaattacaatccgtattataaccgagtctattttaaatcagtgcctagtgagatggactttggccaacatactttggcaagtacgactgaaagttatcaaccaacagtcaatcaagcattaagcatccaggacgaacgcgcactaggatcgaagtggactttgaaagcagcactcgtacaaccttttacaggtgatacgcaaaaagcaccgctagaaggcgacttaacttaccagcgtgccaaccaattaccaacgatgattacggcgcaatcaacgattattgcgacgactacaacgacgagtcatgatccggttgatatttctgggcaatggcagaatcaattagggccgcaattagtcgtgccagtcggcggtgctttaatcgatcaatacgcggctcaagtcgaatggacgttggaagatggtgttgctaccgaataattgcgctggttaaaaaacaaatcaaaatttgtggtgctaatgttgatcatcggaagcggcctaatcgttgtaaacccaactcatacaagtgctaacgcacaaacagcgactaagagtgttgcacgagttggcttttacgaaacaggtcaaccacacaagcaagcgccaatacaaaccgaaacaaaacagcaagctagattgccacagaccgggacaagctcagtcgggttaagcacgattgtgggcattgttttactgatcggcagtttagggttattcaaacaaagacgggggaatttttaaatgaaaaaatttatgatgagtactttattattgagcgggatgttaagcatttcaatgggccaagtacatgcggccgatactgatagccacgatacgactggtaaggttggttttaaagcaccagatactggtggtttaacaatgactaatacagatgctttaaatatcgattttgggtcaaatcccatctcagcggatgataagacctattccaatatcaatgatgctaaagcaaccgttcaagatattcgagggacagcagctggctggacattgacagttgcccaaaatgcgcaatttaaaacgagtgataacactgaattaacaggtgcgcaaataacaatcaaaacaccaacattagatactgcttcaacagccacagcaactgtcgatcaaagcttggtattaacaactgataatacagctcacaaaataatgggtgctgcagcaggtgaaggtaatgggactgccattgctgacatgaatacgggctcagtgacattagacgttcctggtaagacagttaaagtggctaaggattatacaacaatgttgacttggaatttagcagatgctccagccgacaactaaatgaaacgcaaatatcgtttaatgatctggggactcgttttattcatgagcgtgttcgttaatgttaaagtagccgacgccgctaataacgccggctttgaagtgattccggtcgcctctaaacaacagttaaatcaaaaagtaacctattttgatttaaaactagcgccaaaccaagccacaacggtgacggtgaatgttaagagtacgagtcaaacacccatcactgttgaaacctcagtggccaaagcaactacgaataccaacggggttgttgaatataaggcttttaaacaaaataaaagttggggactacctgctaatattgaaaaagtagtcacgactgatcaaaataaaatacaattacagccgggcgaagtgaaacccgtggcttatcaaattaagatgcccaaagcggcgtttgatggcgaactcgtgggtgggttgaattttgttaaaaaggtgaccgatgacaaagtaaaaactaacagtagtatgggtgttaagaatcaatacgcctatacaatcgcaatggtcttacatgggcaacaagaattaacaaaaaataaaatgagtctgggtaagataacgacgcgccaaattaataatcgcaacgtcatcagtatcccgttgaataaccaaactgccgcctttttaaataaggtgacaacgaaggtcacaattaaaaagcaagggcaagccaaagcagtttatacacaaaaaacagctgacggtcagatggcacctaattcagtttacgagttgccggttaggattggtgaaacggcctttagaccaggtcggtatacggcacaggtcgtagtaacggctaaacaacaacactggcaatttaccaaagactttacgattactaaaaaacaagcacggcactataaccaaaaagcggtgattaaagaagacgattcatggttaggtctaagtctaatcattaccggcattgtattgttattaatcttaatcattgtgatttattggcggaaacaacgtcgaatcaagttattagaaagtgaattagcagccagtaaacgagacagcaatcaatagatggaatacttattggaagcagaagattaccagagccttcttttatttgcttatatcgaatcttcaccgacgaatgctgtttcggttaaaatgatcgaagataagtttgatttaacttattttaaggttaatcgtttaatgggagatttaattcaagatttagaaaaattagatttggatcagtatttttatattgaaaaagaaaatggtgaataccactatcgaaaaaacggcttagattcaatcaaacgcttgctgtgggtttattgtcgacgctcgctgagttttagtctgattgatttcatgctcaaacaccctggggcaacaattgaagagttttcggatgaagcctacattagtttgacgaaagcttataaggttcgtaaatctgttcggaccttcttgaaggaataccaaattaaagggttcgatactaaaaatgtgcatgatgaattccgattacggttagtcttaacgcaactttattaccatgcgtttaaagattatgaattaccgtttgaacaggttaaaattcaacgtgcagattatctggttgagcttattggaaaacaaggtattattgcgactatgacggatgctaagcgggtctttttaaccttttattgtttgattgctagtacacgcatacagcaagggtttgaatttaatgttgaaccagcatggcaagcaaaacttggcgaatatcagtcgcaaatagaacaagtacaagcacaatggcctaaaggcatgttgccaattaagtcggacgagattgcctatttatgtcagctattaaatattttgggctgggaaaaagcacctcatcaaaatgttgatttattgccagctgattttaaaaagcgggtcttggcgattttgcagtcatcgtttagaaaacatcaagaacctgtgcaattaaatctaacagatagtccaattcttggaaaattatggaaactttgtcaacgttattactacgatgataatatcgtcttagatggttttttcagtactaacttgagcgtctttgaagaaaactattacgagttgtatcaaggttgtctaaggtttattgatacgttggaagaagaacagttattgaagaaagtgaaaaaccataagacctttatcatggagcttgtcatgattgcgttgaacaatttggattttaaagcacttgtcccaagtattacggtaaccgttaacttttcactaggaatgtcgtataatcggttcattgaatctaatttacgggcattgccatttaataatattcagattaataatcaatattcagaagaaacggatatttatttatcggatgttttgagtcgacatgtccaatccgactacattatttggaatagtccgccaaatgcaattgattgggaagtattcggtaatttagtggcacggattaaggaggctaaacgatgcgattaaatgcgattaaactcattattgtgggtgaccccaatggttttttcagcagtcgctttttttaatcaggttgatacacaagccagtcctaatgccgggatgatggttgaagttgcggcagatagtcaaggctcagatggtgataaggatagtgtgagtgtcggcttttatcggaaaaagcccaaaaaggatcagcactactcgcttttgaatacaccggtcgattatgcgccaacgagacagcaattgaagcatctgccagtctattttccaccagttgacgttgagaattattatttagggtaattgcgtaaaaacttaacggcgttgatagtcggatgtatgacattaatcggttttgtttattttcaggtgaatatgagtcaagccgccaaagacattcaaaaaagtgagacgcaaatgtcttcgaataagcagtcggctagtcaacagtcttcaaaaaaggagagcgtgatccaaaagaaacaacctttggaaccaattcaaccattgagaacaatcgcgattgatgacggtattcataattggcaagaggtttcgcaagcaacaattgaatcgattccagtaggtgataaacagacgctaaactatacgtttggtaatgatgatggcacgctagaggaacaaaaaagtgctgacagttcaaccttgactaaggggatgccgcctaagatgaatatctttttagtggataatggccgtaaaataccgttttcttattttccggcccgtggcttaaccagttcgtatgattatgcattaaccaaggaaaaggatcaaaccggtcaatcgattggtgatacgtcgattagtagacattttaattcgtttaaggtataccgtggaacggattcaaaaggacaagcagtattgaaggctgaaggacaagtgcagtatctgatagatacttatcaagttgaattagtcctacgaccatcgctgaagaagccagtcattcaacaagagttgtatattgccaatgatagttatcttttaccaagagaggcaggcatcttttttgcaaaagatactgctttaaatggtaacgatggcgccccagtttacgcccaggcagataatgcgggattatctattgcaaatgatgggtataaactcttcatgaatatgaatacggcagatgggccacttcattatatggcaaccgatttttctaaaagtggattggcatatgattcttcaaactatgattatcgacattatcgaccagctacttttagtggtgtggggcttgaggcggataatcttgctgaaggtggcaccgatcagattgctggtgctgaggacgccaccaagattttgattcataaaaagcaagtggcattagacaagcaagtccgcaatgaaacgatgggtgaaaaagattatcaaacaacaacgacggttcatccagatgacacgatagattatcgcatccgtttttcagcagatgataagatgactgacaaaatatcgacaactgagttacaagatacgttacctaaaggtttaacgctggtccctgattctattttgattaaatacagtgacggaacgagtgaaaaggcgagtgacttaaaggctgttaaactccatgcgttaactgcgggacagcatgctgatattgaatatcaggtgaaagtcgcccatgatcagataccagatatcgatttaaaaaatacagtcacttccaaaacggcaattgctgatagtacaacggttttaagaggcgcaactgatgcgaccgttaaatcagctaaaccggctaaggggcaaattactttccattatattgattgggcaacaggtagtccgattggcgctaaagcggtgacggtcaaaggattaattggtaagccagtttctgaagcggcactcgctgatgtcagtgggcatcaagatcctaaccaaattcgaccagcaaatattccaagctatgtcccagtcgactatacggaccaagcggatttgagcacggctaagttctaccggattaaggatgttgatccgctaattaccgccacgccgcaagattatacgttccgttatgaacgttctcgcctagcgatgacggtaccggctgacatgaactttaaccccacttctgatacgcaagcggaacggacgtattatctaccaggacaacgtgaaggtgataagaaggtgccgtatggggttgaagtttccgattattggggtattaacgactggcaattaggtgtctctcagacaacgcaatttaccggccaatatacagaccagtatcaaaagacgcgggatgttcaactagacaatgcgcagcttcaatttaataatgctaatttcaagctcgttcaaactgatggcaataatagtcagcaaaataacgatcagattgaaagtatcgcagcgtttagtttgatcccaggtgataagcccaaaacgctagtgacctaccacaaaagtgggcagtatcggcatcaacaaactgataataaaggaaatctaacctatgatttaccaggttattcgatttatcagtaccgctttggcgatccccaaacggccgattatagcatcggtctccacgtcccacaaacaaccaaacggtatcaaacgcattatcaaacaaccctaaaatggcatttaacggttgcgccataattgaaaaataaaaagcaacaggtattagcattaagccaatggtattttgaaacgagtgttatttcgaagcaattaaatagtttgtgtcggacgcgttgtatgacgtttgaacagttcttatttttagaacaacttgtgcaatatgggacgcaatcacctagcgaattggcggttaagtttaatacatcgggtcctattgtgactcgaaagctcaatacgttaaaggataaaggtttgattaaaaagactcgggggacacgattagatcagcgagtagttagtatcccaatgacagaacaaggaaaagtactctacgaccaattatctgcagaattagcaagttggtaccaacaacaacgggccacaaaaactgcgatttttaaacgtttctttctagttggctaaatgagaatcgtcgtaattggttcagtagcagcagggacgagtgttgctgctaaggcccggcggaacaatgaggatcacgaaattgtggtctacgaaaaagggactgatatctcgtattcagtttgtggcatgccattttatctcgggggtgaagttgaagcgctcgatgacttaattccgcgggacgcggcttggtttaaaacccggtttaacgttgatattataacggccacagaagtcgtttcaattgatgaggtccaccaaacgctactggtcaagcatttaccgactaatgaaattgttgaagatcactatgacaagctggttttagcaaccggtgcagcaccacgcgtgatcgcaccatttgatcaaggtcatgacaatgtttttacactgcatcatatgaacgatacccgtgcaattgatgactatctcaaaacgaaacctgtttctaatgtgcttatttttggaacggggtatgttggtcttgaaatggcggaacaattccatcgacgggggttatcagtgacccttgtgcaacgcagtcggcaaatcatgaccaattatgatggcgaaatcgcgtatcgcgccgaacaagtaattcttgaaaatggcgtgaatgtcattaaaggcgtgacgactgagtcactggaagtcgaagaacaacgaattaccgccgtgaagttgagtgatggcacccaattaccagccgatttagtactattggcaacgggggttatcccacaaacgcaattagtcgatcatatgggaattgccaagggaacctctggcgcaatacaagtgaccgatagaatgttaacctcggtcccaaacatctatgcggtgggggacgttgccgaaagcttttccttaattgacgggtcaccactttaccgaccaatgggctcaactgccaataagatgggacggattgcaggggatgcaatgactggtggtgcattagcacatcgcggcattttaggcactggtattgtccggttgtttgatacgacagttgcccagactggttttacggaaaaggtcgcacgtgcaaaaggttatgaaatcgatgtgttatacaatatcaaaccggggcatgctgattatctaaacggcacggaaaatgtcatcaaagcaatcgccgatcatcaaacgggacgcttgcttggcgcacaaattatcggccaagatggtgttgataagcgaatcgatgtctttgtgacggccatttcgtttggtgccaaagtggctgatttgttccacctcgacttagcctatcaaccgctctacgcaacgactaaggatccggtgttgtatacggggatggcgttggaaaatgcgcgcaatggtagaccattattatcaccaaccgaactctatcaacaactaaccgcaggggatagtctgcaagtgattgatgtccgttcacaaaaacaatatgaacaacagcatattgaaacggcaatcagtatgcccttaggtgaaatcagaaaacgacttgctgaattagatcctacgatgccgacagttgtttattgcaacaagggtgttacggggaatgctgcgcaaaacttactattaaatatgggctttgagaccgtttataatctgagtggcggtcataagaattaccagttggttaaaacctacttacaacaaaacggataaatggtgaaaatgaaacgtgtatggcaatttggggcggtgggcttagctagcatgatgttgttagcgggctgttcatcgaaatcaaacaaggaaggtcaagcaacggcgagcacaggggcagttggtctttccgtgaagagtggggtctatgtggtgcccgacggtaaaaaggcgagtgacagtaagaaatatttggctttaaacatcaaaattgataataaaaccaaaaaggccctatcagtatcatcatatgacatgagcttatatgataaagacggtaataaaatggccgataccagtgtctacgatgatgataatgggttccaagaattagaaagtggtaatatttctggtggtaagagtacaaccggctatgttgtttttaacgttcaaaaaggccaagaatatgaattgcattataagggtaacgatggcgaagaaaagcaaaaagatgtgaaggtcaagattgatgccgacaagtatccagaccacactaaacaaatgacaaaactcgctaaggaatatgtcgaccaagttttcttaggcgctaaggctgacgataaagcggccttaacgaatgatttacaaaaagaacatgacgattttaaaacggcttttgcagaaagactaggtaaacagtttgataattacaaaccatcaactgcagaattacaaaaagtagtcaccagtttcaaccaaatcaatgccaaaaaagcaactgttgaatattcggtcgctgagatgcttcctaaggcagcaatcatttacgttaaaccggaagtgattaacttcgatgatgttgatttcgaagcaatcattgatgattttacggataaaaatgaagataagtatgatgattatgaaaaagcgacacaagatgccgaaaaatatctcttgcaacaattaccaaccaaattcgaaagtgccaaagtcagcacaccagaatatatggatggtgagggttataaagttaagctagttaaagaaaaaggaaaatggactgtcgatagcgaagacagttcagataactatgattttggtgaattacaaacagcctttatgggtggcctagatgactaaatgactaaaatgaaagccggctggaaaaagattctttttctgggcggctttttgctaacgattgttttagcgtcgggttgctattggcgttatcaatcactaccggcgcagatggcacgtctagaaacggcagtcaataagcaccaatggacggttgttgaaaaaatgataccgcggtttgcaaatggtcgtaaaatttctaaaggaagttaccaattattcgaagcacaactagcgaccaaaaaagcaaaacaggtttttatgcaacaactgacaaaaccgacggcttatcagatagaaaacaagatgagttggttcaagccaaagaagtttttaccacaagcgcgctatctaagttggtcggcaagcgatgtgcccagtaaaacgaccatctatattagtgggcaaaatcagttgtggcaattatctaaccaaagccatcagacgcagcagacttatctcccaggacaatatcaattggatttgacaatcaataatcaatgttatgggaaagtcacgcaacaccgccaagttaacctgaatcagcacaactatcaactgaaattaacgcccgattattttataaaccaacctgattttcaaaagcaccgattagctgacgtattgacctattaccaatcgttaaatcaaagcatcaatcagcaattagatttcagtcacttggagggtgtaaccgccaaggatcgtgcggaggttgcacgggtatttgctatgttaaaaccaaatctaaaggcctatcagcaacaatttcaagaactagcgatgaacgtggattcgttaaagatagatggtggacaagaacctcaagttacctttgatttatatattgatttaaaacaagctgttcaagtgatagcaaaaacagataaaacgacttttgaattaaccaatgatgatcgacaaaatgcaacggtcacgatgcaatacagtacggatgaaaagcagtggttgatacaaacgctcgattttgaaacctacgagcaagcaccaagcgagtggatgcataaacgacaagttcggttgaagcagcctaatcaggctaattggcaggcaaatcaacaacaggaaacctaaatgaagaagttaatgacatggataatgttaggcgttatgttagtgtgcttgtttattattcagagcagtaatgtaatcgcagcgcaacaagatgtttctaaggcaagtacaagtctaaagtcagaatccaaattaaaatctaactcaagttcaacaaaagacactagtgaaattgttagctctaaatcagtatcaaattcaacttcgagttcgagtgatgaggcggagtcgagtacaagttcgaaatccagcagtaagtcaaccgaatcggttcttgttcaatcgagttcatcaggaaagttacctagtatcgagagtgttaaggaagctaatgaacaattagttaacggtaaaagcacaagtaaaagtgtaggggtttcaccagatgggttcaatgatggtattacggattggaaggaagtgccacaaaataccattgaatatttaccattagatgatccaggcgttaagttgggatatacctttgggaattctgatgggtcacttaagagtgaatataattctaatgatccagcgcctacgacacgtgattatgtggatcctaagacaaacgtgttcatattagcaaatggaaaaattattaatgggttccataaaggaaatcaaggactgactacctcgtatggttacgctttaacaacggaaacaagtaatcaaaaacaaattttagctgagacatctattccttatttaatggataaaggttttaaaatttatgaaggaaccacgagttataataagccagccttgaaagctgtcggaatcgcaactgtaaaaggtgtcaaactaaaagtggaattcgtcttacgcccatcagaggaacagcccgtcattaaacaagaaatgtatcttcaagacgttggtacaggtaatgaaaccgtcagaattttctacgcagaagatacggaacttgatgataatcaaggacctgatatctatgcacaaggtaaccgaaatgggatgtacatgatggaaaaaggttacaaattcattatgcaagataaaatagccgatggaccggatcattatcaaggtatccgttaccaaaccgcgggtgcacagatggatacgcaatcaaaatatgggatggcagattatacctattatggatcgtcactgggtggagcggatttgagtccgtttacggttgatgaaggaagtcttgttgctggtgctggtgattctgcgcttggcgcgatgtgggaaccacaaactttagatgctactaaggtctatcattatcgtaatgatgttgggttctttaatgagggtgtggttgtgccggaagccgtagtgtcatacacaaataatacgactactgataaaaagaatcatgtcttggatgagataacgttaaattttgcaactcataatattggattcaagagtgtgtgggataacatcacaatgaccgcaacgattccagcaggattaacagtagatcctaaaactatgaaagctaaattgaatgatggttcggaagttaatgttgatgttaagagttataacgcctctactcataaaataacttataagttacctaaagatttagcggataacgaatggaccacagtatcggttgacacgaaaattaatagtaaggcctctaataagaccttacagccaagcatggtatctcaaggcggtaaagcattttataacaaggcgtcagcgcagacagatattccagtagaattggcaccaactgttattgataaaacggttcgtaacgaaagtgaaaaagaaactgaatatcaggatacaacgcaagttcatgcacgcgatgttctaggatttaagcttaagttcacggttgatgagaagagtagcactatgaaaacaaccgctctactcgatgaaatggataagaaattggaattggttaaagaaactggtaagaagccgattaaagttgattattctgatgggacgacagaggagtttgatagtttagggagcatgacgttgaaacaaatggagccaggagattccgcgacgattacttacaaagcgaaggttatggataccgctattgaaggtgatattttaagcaataaggtaacaacgcttagtgaattgcctgatacaagtactacagcaagtgaatctgaagttagcatggaaacggtgaagccaaaagacagtaaagtgcacttcgaatatatgaccgtgcaactggaaaagctattaatgatccaatcactgttcagggtaaaattggtgaacacgtttcaaccggaacaattattgaaggtgatcttaatggaagtaaggatgtaaatggatgaggtaacctacaaaatttactatgaaaaggcgcgtttaggattcacagcgttacctaagaaaatgtattttggtaagttctacgatactaagattgaccgtactttctatatgccagcgcctaaagatcccgcaccaaaatcaatgaaatatcagaaaacaccatatagtgttgaaatctctgattattggggaattgatagttgggcgctagatgttaaacaggttggtcagttccaaagcgattacaagggtgattctaatacaccaagtaaacacgttgaattagaaggtgctcgacttcaatttagtaatgcgaaatttttgatgacgcattctgaagggaaatcgacggaaggttcaggtaaaggtgataagactgaatccctagatcatttcaatctagttcctaatggcacaccaagacgcctggtaacacataaaaaagagggccaattcttgcacaaggataacactaatggctctgttgcagatgacggtactgataatagagtaacgtatgatcgccctggatatgcagtttataagtatcaatttggtgatgaaaaaacagcggattacagtattggattgtttgtaccaggagcaacgaagcgatataacacgacttattcgacaaccttattatggaatctaacggttgccccataagtgaaaatgaaaagcatagcatttggccttttagccggtttagtcggcttaggcttacaaatacattctgtatcagcggcgactgatgaacaatctgattttgaaatccaaagaattccggtcgaaacgcaagttaataatgacgttaattacttcgatatgcagatccaaccgggtaagaaacaagtcattatgatgaaggttaagaattatacggatcataaagtgaaggttaaatcagaactcagaaatagtatgacgcaagtcggtgggggcgttaacttcatttctacagctaagggtttggatgaaagcttgaaatatccactaacaagtattgggcatgttgataagaaggatcgtgtcatcacccttaacccattagaaacaagaacagtttcagcaacgattaagatgccaaatgatggtttccgcgggttagtctatggggactggcatttccttgaagaaacgacaagtaagagtaaagattctcacgtttctagtaattacgcctactcaatggggattgccttacgtggcgctcattacaaggtttatccagagttgaagtacgacagcgttaaaccaatgcttttccaaaaacatgcggcaatgtcaattaatcttcggaacacgcaaccaatgatgctccaaaatgtgcaaatgaaggccgttatcaccaaacaaggtgtcttttcacaaaaacggatttttagcgttaataatagtaaaatcgcaccaaactcaattgtgacattaccggttcaatggcaatttgatgaattgaaaccaggtaaatataaggttcaagttcaggtcaaaggtgaaaatgactggaacaagttaccaatgacttggaaattcattaagaatatcaaagtggataagaaagccgctgataatatcaatgataagattatgcgcaaaccaatcaataagtggttctacattagtatcgcaactggtgggttgatgctgatttcacttgttgagttactgaaattactattaacgggaagtaaataaatgtcatggcttaacggacggaagaatagttggctaatcattgctatttgtttcgtaacggccggtttattgttacaaccgatgagtgtcgaagggaaaaaggccaagtataagtcgccagatgaagatccggtaactattacgattttacctaaattaccgaatgataatattgggggaaaatgtctcggttacttcaatttgcctcagcaaaagaagcaacaacgtgtggaaaagattaatgtttttaatccaaccaaccagacaattagactcaaaattaaggtcgtagatgccgcaaccaataataatggatcaatcgactatacaaaggcacgtcaacctgaaaagggcttgttgaaacaagctgggagtcaagtaattgcggtccctaagagtctgatgattaaaccacaagaaagcatcgatatcccgattaagattgataaaccaactgcctttagcgggattaaagcatcagcgattcaaatcttagcgagtgatgaagaagctagtcaggcggctgttcaaaacgagtatgtttatacaatcggggtgctgcttaatggtcgtaagttaacgaagaaggatgttcaaccgcttaagatagatcagatcgatgttcaaaaatctggtggtcgagcaacggcaattaaattccattttgaaaatcagatgccgatgtatctcaagcaaatgaatttgaagacgacgttagtaaatcagaaagtagccttctttaaatatgaaaagtaccaaaaggatatgaagattgcgcctagttctaaatttaccgataacttagccttagggggcaagcgattggtggatggttattatcgcttaaccgttgagaatcaaaacgacgagtatcagaaaaaacaaacgagctatgtgcggattaagaacaataagattgaatttatccaaaagaacacttaccaaaaagaacaacaacaattcctacgatggcttgctgctggaatcaccgcgctaatcattatcgtgattggtacttgggtgatgattaaacgaaagaaggcaaaatgaatgaaacgcttatggataacgagttatgttaatcaaaccaattatcgcaaggttaagtggggcatgattgaactcaccgttgtgttagcagctgcatttatcgttagcacgtactttgcaattcgggtttaccaagacttcaatagtttcacaacgattacgatgaattagatgaaatttacgaaattaacaagtgctgcattagccggcgcaacagtattaagcattttggctccagcgacaacaaccttcgctgcaactcatgaaggtggcgtgatcgataatggtgggacaccattagcacaaactgataaatcagaagttggcgtttcattcggtgataacatcgacaacggtaacactggtttcttacgtttacaaaaagtgccaaaggtcttggattttggtaaccatgctacttttgacaaagcatttacaacattcacagccgatggtaaaaattatgccaacgacaaaaataaccaacatgcttcatatgacaactcagttgctaataaaacacctcttttaaatgcaggtagtgatacagcgcttaaagatgttgccaatgatgcttgttgttgaatgcaggtagtgatacagcgcttaaagatgttgccaatgatgcttgttgttgataaacaagtgacacgtcaacatgcagacggcatggatgctgccacaactcaaaaagctggggattgggatttaaaagtatcaactactgaaccattgaaaacgacaagtggtcaagaaattgatggtgctaacctcttattcaaacatactaaatatgcattgacatctggtgtttatgaactaacaaactcagatcaagataagacttttgcgaaagatcttgctgattataaagcaagtatcgcaacaccaccggttggtcctaaagccaatggtggtgatgatggcgatggtgatggtggcgatccagcaccagcaccatcagctggggatgttgcaatcaatgaaactgctaaagatgcaatcacagatacattctcattatcactagcagcaccaacaagtaagttgggtactgcagccggtacagtagttggtaaagcagatactgatacaggtacaggtgctaacgtcttcgcatgggcaccagaagatatccaattagttatgccaacagatgctgcagttgcaaatgcaatctacaagacatcattaatatggacattggaaactggtaaataaatggattatttgagccagtggtatattgaataccgatcagtgtcatctaacttgaatgcgatttgccataaacacgatattagtttagaacaatttttatacttagaaagacttgttatggaaggtacccaatcaccgagtgagttggcaatggtatttaaaatatcgagtccgattgtgacccgtaagttaaatgtcttgcaagacaaaaaaatgattgaaaagctacgtggcgaacgccaggaccaacgcttagtcaacattacaattaccgatgaaggtcgcaagatctacaagaaggttaatcgcgatattaccgaatgggaagagcaccgtcaaagcacggcggttccaactttgggtcgtagttttcttggacaacaataagtggaagaacagatattacaatatcgagatgccgtttatgagcaagtcgtcaaggtagggaaatcattagggaatgtgacgcgcttgcggatactagatttattggtgcagggtcccaaaacggttgaaaatttagccaatacgattgggttaagcgttgcgacaacgtcacgcaatttacagattttgaagaaggcgcgcttggttgaaattgaacgacataaaaattttgtaacctaccgcttaacgtcagatcagattaagcagcttatatcgttattagtcacggtcgcagaacagtcacagcctgaattggcagccattcagacaacgttcaagcaacaaactggttcaccacaggcgttaacgatttcggcgttaaaagcgaaattaaccgctgaatcaacgtacttagttgatcttagacccaatgatgagtatgagacgcaacacttgccgggagcgcataatatcccatatgatgagttaccacaacatttagccgaattaccgcaagataaggaaattgttgtctactgtcgcggtcggctatgtgcttatgccaatgtcgctagtcaggcgttgcatgatgcgggtttcaaagtggcgacctttaatcaatcggtgtgggaatggaatcagttgatgagttcctaagtgatgacagcacaaattttaaatgaagccaattttaacgatgagattaaagaaggggtcacactagtcgatttttgggcaacgtggtgtccaccatgtaagatgcaaggaccaattgttgaacagctagcagatgattatgcaggaaaggctaaaattgccaaagttgatgttgatcaaaatcaaaatttggcagcgcaatttggcattcaagccattccaaccttattaatcatgaaagacggtcaattacaagaacaactagttgggttgcaacgtaaagaagcattagcgacaaaactagatgccacattagcataaatgagttcaaataataatatagttaataatatcggagaacaaattaaacaattaaggcaaagtaaaaaaataagtgtagaaaaattatcagaattatcaggactaagttcactaactataacaaagatagagaatggaaaatcgaatccaacaataaatactttatggaagttaacaaaatgtctagaagccccactaatgtctctatttaaaaatagaggaagtaatgtcgttttttcaactgaaaatcatggttattttttagaagatgaaaatcacaagtgggaagtcgaaccaattgtaggtcaatttgatttcgaggtatataaagttcggctaaaagctaatagtaagtattatctagatagccagacttctaatactttagaggtgataactgtactatcagggacattaaatcttagagttaagcatgatagttatattgttcatgaacacaatacaatttacttcataaataataattcgcatgagtatattaatgatactaatgaagatattttgatgaacatagttgtaaaatatgagaacctataattggcttttgctattttatcaccagtggcacccaaaatagctgaaaaattgagtctagaatatactattggttattctacaatcgtattagttatagggttatttattagatcaattccccaaacaagcactttattatttggaactattttagtaggtagtgcaattgccatgtgtaacgtattaattccaagtttaataaaaagagaatttaatcatcgcttaggcctaattactggtatttattcaattagtatgaatttatgtggggcaattgcatctggagttagttttccattagctaataatctaaatctaggttggaataattcacttaggatttggcttattttggctttaattgcttgtatcgcatggattccacaattgaaaagacatgataaaccagataagatagaggaattacctatagagaatagtatttggcattcaaaaactgcgtggcaagttactatatttatgggcctacagtcactagtattctacgtgttagtcgcgtggttacctgaaatgcttattcaaaagggattcactgcagaacaagctggttatttattgtcaatgatgcaattatttttattaccatttacatttataattccaattattgctgggagggtcaaaagacagagtaaaattgccataaacacatcaatcctaatgtgtttaggaattagtgggctttttataaataatactattattataggaattgcttttattgggatcagtggtggctgtgcatttggactatcaatgatgttttttaacctaaaaacaagaaatgcaagagaaggggcagaactatcaggcatggctcaatcaattggttacttgttagctgcaattggtccaactctctttggctttatgcatgatatgactcataattggaatgtatcattaattattttaattgtgactgctattttattagggggatttggattctttgctggtgaagataattatataaattaactattttaaataatccgtcatgactgctttaaagaagtcgatgtgtttgaggtacatttcttcgtcaacgtattcgtcggtcatatgactggtatcattgccggggccgacaactgccactggtaagttggggttattcttagcaaagtgggcggcatcagtaccaccagcaacgtgcatcagtggataagcttgggataacttttgtgcgccgattttttgaacactttgaatgaatggtgcctgtggattacttttaaccggtggttggttattaatgacagttaatgctaaattcatgtctgtttgttggttaagttcagcaataatggcattgaggtcggcaatgacttggtcgccagttaatgcgggggttgtgcgaacgcggcaagtgagttctgcgtgaccggggaccgaattaatttgttcaccaccattgattaaggttgtgacgggaacaatatcgccgaggacatcatcaataggatgcttttgatcgaagtattgtttttgccgattgtagtaggtgagcaaatggtcaattgcgttaataccgagttcgggcattgaactgtgggctgttttaccagtcgccgtcactttaaaatcaagggaaccgttgtgggcgaaaatcagaaaatgttgttcattggtttgattggctgtcagtagtttttggaccatttctgtgggaaatttgtcgctactggttgccaaggcttgtttatcaacgccagatggttcggcaactaataaggctgtcaaattatcggcataaccttgggccgttaaagtttgggcaccagtttcgttcttttcttcatcgactgttgcaaggagtttgatttgaccgtttaatgggacgttttgatcgtgtaattcgatcattgcaatcacaagagcggccagtccagatttcatgtcagtagcaccccgaccgaagagtttaccatcgcgagcggttagggtgaagggatcactcgtccatttgctgcgatcgccgatgctgacgacgtccatatgaccagtcacgccgaggactttgtcggttgcttcacctagataggccactaagttttcgcggcctggtttagaagccactttttcagtctggataccgtgttgtgtgaatagatcggctaagtagtcggcaatcacaccttctgcttggtctgttgtatcaattgagaccagtttttctaaaattgcgattttttcagttttttccatcatatggcatctgttattaatgaagcacctcaggaaaaagcagaaattccactatttcgtaagctgagttactcactgacggattttgggggcaatgtcttatttgttagtattagtacttatttactctatttttatacggacgtgtttggtctctcaattggggttgctgggactattctgttactgacaaggtgtattgatatgtttgacgcaccaatctgggggtttttaattgatcatacgcatacacgttggggacaaagtcgaccatactttttatggttatgtttaccatttgcggtattcacgtggttaacgtttacgacaccaaacttgtcaggatcaacaaaagtagtttatgcagcagtaacctatgtgatggcaggcattttgtatacgggtattagtacaccaatgacatcgattttacctaatctaactaatgatccagaacaacgaacagtattgaattcttatcggatggtaggcggtaatattggattattgattgccaatagtgtcgtattaccattagtccaactttttggacagggtaatgaccggaaaggattttcgattacgatgattgtcatgggggtcgtatcgattgcagccttcttaattgccttttggaatttaagagaagtaaatgcagtatcaacacagtctatttcattgaaagaaagtgttaaagcaactaaaagtaattggccttgggtcttaattgttttaacaaacttattttattggattggtacaactgttagaagttcagcaatgatttattatttccaatataatattcatgccaaagcactagtatcagtagcaggtggtttatcagccgtagcagtagtgggcatgattttaattccattatttgttaaaaagacaaataaatgcacagtgctaattggggcgctagtccttgctgctatttctaatctcttattacaagttgttggagctaatcaagttgcagtggtagtgctctattgtttgggttcaattggaactggggttgctgcagcaatgccgtttttgatgcttgctgatgcagtagatttcggggaatggaaaaatggtattcgagcaagtggctttttaacagctatcggaagtgctttttgtgtcaaagcaggtagtggaattggtggctttgtaccttctaaaattatgcaatactttggctatgtgcctaatcatgcacagtctgcacagtcattaattggtattaattttagctttgtctggttaccagctattttattcttggttgctgccattccaatgttcttctatgcaaaatttgaaaagaatgaagcagttgttcgaacagaattagcaaaacaagattaaatgcaaaatccaaaacttgaagacgtcgcagcattagcaggcgtttctaaaacaactgtttcgcgagtattaaataatcgaggttatctaagtgaaaaaacaaagcaaaaggtattcgattcaatgaaagcgttacattaccgacccaatgatgttgctcgccaactgttttcaaaagaaacgaaaatggtcgggttgatttttccaaccactgcgaatcctttttttggtcagatggcggcgcagttagaaatgaagctgtttaatgccggttataaagtattaatcggtaattcaatgaatgaccccttaaaagaaaaggaatatttacagaaattactggctaatcaagtagacggcttgattgtcggtgcgcataaccaaaacattgcggaatacaacaatactaatttaccaattgttgcaattgaccgggtgatgaatgacgatatcccagtgattgcttctgataattatgatggtggtaaaaaggcgatgacattactgctaaaacggggtgcacgccatatcgtgcatacggatggcccaactgatttgcaatcaccagcgttagatcgtcggcgcgcttacgaagatatgatggcagctaatgatttaccaaccattgtctatacggttgcgcttgattcatccgatgcacagaagaaagaaacattccgacaaatttttaaagaaaacaaaaaaattgatggcgtttttgcatcaaacgacgttgacgctagtctgattatccaagttgccgccgaatttcaaaagcaggtcccagaagatttgctagtggttggttacgatggaacagaaacggttcgcttatttaagcctgaattaacaacaattattcagccgatagaagaaatggcggcaatggcggtatcaactttgatggatcgaattgagggtaaaaaaacccctcataaaattatattaccagtcacagttcatcaagggacaacggcgtaaatgacaaaaaaattaaattatccagagataacaaatgacagatatcgattgaattatcatattatggcgccttccggttggattaatgatccaaatgggtttgttttttttaaaggctactatcatattttctaccaatatcatcctgaatcagttaaatggggaccaatgcattgggggcacgttcgtagtcgcgacttagtacattgggaacaattaccaatcgcccttttccctggggatgctgaagatccagatggttgtttttcaggcagtgcgattgaaaaagatggtcgcttatatttgatgtatacggggcaacacttgaaggataatgaccctgaacaatattgggaaacccaaaacctagcagtcagcgatgatggtattcattttgaaaagtatgctggtaatccagtgattgcaaccccaccagaggacaatgcacgagattttcgcgatccaaaggtttggtttgatggtcaaacttacttcgttgtgattggcagtaaagatcaagctggattagggcgcgttttattgtatcaatctcagaatttaattgactgggactatatcggaccgattgcaacggctaagtcagttgatgaagaaggttatgtctgggaatgccctgacttcttcaacatggcagatcaggatattttaatcatgtctccacaagggattaaagccaatgggttgaaatatcgtaactaccatcaaaccggttatctaacggggcattatgatgaggccaataaaaaattcaaacacggtgcatttcgagaacttgatcatgggcatgatttctatgcgactcaaacgacagttgcgccagatggtcgccggattcttttcggttggttagcaatgtgggaaagtataatgccagaacaagcagatggctgggcaggtgcgctaacatttccacgagaggtaacagtcactggggataaagtgttgatgacgccagtgagagaagtggcacaattacgagcaaaacaattattaaagacaacgggcgccaatctctttgacgcccccactaaaagtttagaatatttaggccagtttgatagctaccatgatgtcgcaattaaagtagtgagagaagatggtcagccagtaattattttacggtacagcgcgagcgaacaaacagttagtcttgaaaaatataatgatgatcaacaacgcgtggcttcggttgaaacaaccagtcaatttgacgtgcatatgctaatggacacgagttcaatcgaactatttactaatcaaggagaagcttgtttttcagagcgaatttattgtgaagaagctgtgcatattgaaacaattagtgaggtatcaactgatacaattcaaatttatcaacttggaggaatggcgtaaatgttattaggtagtattgaagcaggtgggacaaaatttgtatgtgctgttggtaatgatgattaccaagtaaaagataaggtgcagtttccaacgacgacacctaaagaaacattaacaaaggttgtcgactactttaagcagtttgaaattgatgcattaggggtcgctacctttgggcctattgaaatcagaaaaacatctcccaaatacggttatattacctcaacgcctaaacctggttggcaagatgtcgattttatcggttttttaaaaaaagaaattgatgtcccaatgtcttggaccacagatgttaacggttctgcatatggggaatttacgatggccacgttattcaatgaaaagattaattcgctcgtttattacacaatcggaaccggtgttggtgctggggcagttattaacggtcaactcgtggggggcatcggtcatccagagatggggcatgttcttttaaaacgccatcctgatgatttagagttcaaagggatttgtccgtttcacggtgattgtttagagggattagttgcggggccaacatttgaagtccggactggtgaaaaaggggcagaagtacctttaactgatcaaacttgggatattttagcatattatatcgcacaagctgcgcttcaaacgaccctcacactacggcccaacaagattgcctttgggggcggcgttaccaatccggtgttgttagaaaaagtacggacagaattcgctaaattattaaatgattatgttcaggtaccgccactcgataaatatctaacaatgcctagcgttccgaataatggttcagcaaatgttggtaactttgcgctagctgctaaattattggttggttaaatgacagaagcatattattatgacgtcacaaattggcctgttgggaatccttttgaagacgttggccaagtgattaacagtatgattgaggatattaagaagaaacagaataatcgagatcttgacgaaggtggtaagccaggcgcagtgatttatttaccacctgctgattatcacttaaaaacccaagttttaattgatattagttttctcaaaattatggggtctggtcacggctttacctcttcgagtattcgttttaacgtcccggaagaagatgtccctaatctacacgaattatggccagggggcagtcggattttagtggatcttgaaacagcactagatgcacctgaaattgagggtgcggcctttgttgttaaacgagagggtgacccacggattagttcagttgaattcaataatttctgtatcgatggcttacacttcgtcgatgatggtacggatgaaccgaatgttgaaaatacttatgttaatgggaagactgggatttatgtagcgagtgcgcaagattcatttttaatttcagatatgggtttggtttatctcgaacatggtgtcacgatttataatgcagatgccttaacaatccataataattttattgctgaatgtggcaactgtcttgaattgcgcggttggggtcaagcgtctaaagtaacgaataacttgatgggtgcaggctttaaaggttattcaatctatgctgaacattttgcacaactcttgattagtagcaataatatttttccacgaggcgcaagtacgatcgaatttaatagtgtcacacgttcgtcaattgtcggtaatatcttgcacgcattttatgcagggatggtcatgctgaaggcgaacagttcagagaatttagtttccggaaatcactttttacacgatcatgaaccttggaagccgatgcaaatgcacgataatggtttagatgatctctttggtttattgacgattgaaggtcataataattcagttattgccaatcatttctcagaaattcttgaccgtgaatttattaagccagtgggggctaaaccggtgattatccgtttaattagtggtgatcataactatattgccactaataacacagttgcgactgaagcccatactgaaagcggcgattccgcttttgcggctcaagttgactcgctattaacgacggaagtatcggcaccaatcgatgtgacgaccgttcttgttgaagcaaatgctgttcaaaatacaattttagattcaggaacagacgagcaagttattttggatcaaaaggtgaatgcatttagagcaacaccatcaatttcaattagatagatggctgaaacaatgattagtatgcaccatttggcaaagcgatttggtaagcaagtggtattaagtgatattaattttgacgttcaaaaaggggaaattgtcggtttgatgggtccgtcgggtgcgggtaagtctactgtgattaaggccattttaggcatgattgccgttgatcgtggcaaagcaactgtatttgatacgcaaatgcctaatcgtgaattgctagctagaattggctacatggcccaaactgatgcgctttacgatacgcttacggcgcgtgagaatttagtgttttacggtaagatgaagggactggataaaacggttctcactcatgatgttgagcatgttgcgatggttgttgatttgcttagcgatttggataaacgggtgataaatttttcgggggggatgcagcgccggttatcattagcaattgccttgttagggacatcagatttattgattttggatgaacccacggtcgggattgatccagcgttacgacaaaaaatttggcgcgagcttcatcaaattcgagatgctggacgcagtattctaatcacgacacatgtgatggatgaagcagaactagttgatcaagtggcattattgatggcagggaaagtgatggcgtttaatccaccagaaattttaaaggcacaataccaagtggattcaattgaatcagtatttttaaaagcggagggtgtgcaattatgaatgaaaacttttgcaattgctaaacgggttttaacagaactatcgcgtgataagcggaccttagcactgatgtttgtcgcaccgatcttaatcatcttattattaagtttaattttttcagcgagttcaacgacgaatactaagatgggtgttgttgcagtcccgacgaaacttgaacagcgcttagacgatactgaacacgtgaccgtcaaaagatatacaactgaatcagctgctaaaaaagccttgaagactgatcgaattgatgccattgtccaacacaaagataatcaatacgacttgacttatgcaaacgtcgatgcggcccaaacgacagcggctaaaatggcattcaaaaatgcattgacgaatcagactattacaggattacaacagaaattagcgcaaactacggctgctttagcggcagttacacatcaacagccgcaaaaacaacagtctactaagcaggtgaagattatcaatcactatgcatacggtgatgctgatacaggtttttttaataaaatattaccgattttgattggctttttcgtgttcttttttgtcttcttgatttcgggtatggcactattgcgagaacgaacgagtggcaccttagatcggttattagcgacaccagtgaaacgttatgaaatcgtctttggctatatgttaagttatggtgtcttggcaattattcaaacattggttatcgtacttgtgacaatcttgattctgggtgtacaagtagttggtaatattggtagcttagtattgatcaacctcttattagctttagttgcattatcgtttggtattttattatcgacctttgccaattccgaattccagatgatgcagtttattccaattgtggtgattccccaagtcttttttacaggaattattccgctcgactcaatggctaactgggtgcaggtcatttcatatgtgatgccaatccgctattctggcgcagcatctagtgcgattatgttacgtggcacgcatctgagcgcgctttggccagagatgatagtcctacttgtattcttagtaatttctactatactgaatattactggtcttaaacggtatcggaaggtttaaatggagagtaatttatttaatgattatcaagagtggtttgaccaacaagaaatgccagctggtaaacgaaaggtgctcaaagctggtgtcgaattgtttgctaaacaaggctatgacggtacttcaactgctcaaattgcaacgcaagctggtgtcagccaggcgacgatttttaaatattttaaaacgaaacaagatctgttattggcgattgtcaaaccgatgatccataatctttttccggtagtgcgcgacgattttctagcgcatctgcaacaaccaacagacttgtcaacattagtccattatgttgtggcagatcggtatcattttttaaaaacaaacgcttcgttattagaaatcttgttaacacaattattggtggatggtcaggtgcgccaacttttcttggaagtcattgttgcctcgagaccagcttttgaaaatagtgtcttaaaaatggtttttgaagaacagctagtgcgtgcggagattacccttagtgatttcatcagaacgattgtgggccaactattagcctatttcttccagaataagttgatgcccactgatcaggttgatgaagcaaccgatctagctagaattgaaagaatcattattaatggattacaataattaatgtgacggctttttgtttgtctgattggtcagggtttctctaaaaacctgaccagcactcgagaagacttggccttttttccagataatgtttgtattgacggttaatggcggattaaacggcacgaattttaagccgttgtccttagtattgataatgccgtcgatgcacaatgcggcgctgttactggttttgaccaataatgaggcattgtataaaagcgtgtaggtcccgacaatatcgagttgatcaaggttagcgccaaaccaattactaatttgttgacggacgagcgattgtcccgaaattaataagggatattgcgctaaggttgctgcatcaacggtcgagtgcgccgcgattgaatggtcgtcggcaaccagtacaccccaatgatctgatacgggtaagcggacgaattcatagcgctgcttatcaacgggatcgatgacgagaccaaaatcaagcaagccttgaccaatccgttctttgacttcatcggcagtgccactaaataattgcagattgatatcggggtagcgttggcgtaaatcattgataatcaccgcaatcagttgaaaggcttgtgtttcaccggcgccgacactgatggtgccactgacgacctgattatgcgttaagttatttgtcgttgtatcaactaaagataagatttcgcggccgcgtttttgcaggtaaaggccatcggttgttaatgtgatttcgcgattgccacgggtgaagagttgaacgcctaattcgacctccaaatccttgagttgtttagagagtgttggctgtgataagtggaggacttcagcggctttactgatggttttctcctgggcaacggttaaaaagtaatttaaaacacgtaaatccatgtggactattcattgcgaacgagaattgcgaaacaaccgatttaccatgattcggagttgcttaaagaaattcacttggtcaaaggcaacaacgagcgattagtgatggaaatgaatactggctatcacgatgcagccgaagtacgggcgtatttaaagtgcattacagatcaagaaatagatgaatcggtggcagtatcattaccgttttatacggactacggcaaacacatcacatttggtaaacagatttttattaataataatgtcctgttcgttgatttaggtgggattacgattgatgatcacgtgttgattgggccgcgcgcctcattaattaccgtgaatcatttggaaaatccagccgatcggcgtgggttattcgttaaaccagtgcatatcaaacagaacgcatggattggcgcgggggcaacaattctccccggtgtgacagtcggcgaaaatgcgattgtggctgccaacgcaacggtcaccaaagatgtaccagctaatatgattgtcgccggcacaccggcaaaagtcattcgtcaaattaaagcagaaaaggagttttaaatgtcaattcaaaataaagtcgttatcattacaggtgcctcatcaggtatcggagcagcaactgccaaattattagcaagcaaaggggccaaggttgttttggccgctcgtcgcaaggatcggctccaagccttagtggcagaaatcggggaaaatgcaatttaccaagccactgatgtcactaatcgagaccagatggcaagcttagtccaattagcactcgatcggttcggtcgcgtagatgtcttatataacaatgctggcgtcatgccccaagggaatctgagcggacgcaattacgatcaatggcaaaagatgctcgatatcaatatcatgggtgttttaaacgggatcggtgcggttttaccaatgatgcaagcccaacaagatgggttgattatctcaactgattcggttgccggacatgtcgtttatccagcttctgccgtttataacgggacaaaatatgctgtacgcgccattatggaagggttacgccaagaagaaaaagataacggcatccgctcaacgattgtctcaccaggtgctgttaaaacagaattggtcaatacaattggcaacacggctgttttcgaaggcgttaagcaattaatggatgccccagaagaatcagcgttggccctcaatccagaagacattgccaatgcagtcttatatgcgattgaccaaccaaaacatgtggtagtcagtgaagtattgattcgtccagctaaacaacaagtttaaatggcagaattgatgcgtttttatcaaagctttcaaccggaacattatcaagtttttctagatattaatcgggctcaaaaacgatttagtggtcggacaacaattaccgggaccgctaaggatgcggtggtcttaattcatcaaaatggtttggtgattgaaacggtaagtgctgcggggaagagcgtgccatttacagttgataatgacgcgaatgccttgaaggtcgaagtgggccaaccaggcgaagtgacattggtcatttcatatactgctgttttaacggattcgatgatgggcatctatccttcttattatcaagtcgatggggtgcaaaaagaattgattgggacgcaatttgaaaccaactttgcgcgccaagcttttccatgtgtcgatgaaccagaagccaaagccacttttgatttagcgattaaatttgacgaacacgaaggcgaaacgattctcagcaacatgcctgaaaaagaagtcatcgatggcattcatcattttgaaacgacagttcggatgtcaacgtaccttgtagcgtttgcttttggtgaactccaaggtgcacaaacgaagacgaagagtggcgttcaagtgggcgtttttgccaccaaggctcatcaagccaacgaactcgactttgcattggatattgccaaacgttcaatcgaattcttcgaagatttctaccaaacaccatatccactcccacattcatggcagttggccttgcctgacttttcagccggtgcaatggaaaactggggcttagtcacttatcgggaagcttacttactgctcgatccagacaatacagcgctaacaacgaaacaccgtgtagcaaccgtaattgctcacgaattggcgcaccaatggttcggcgatttagtgacaatgcaatggtgggatgatctctggttaaacgaaagtttcgctaatatgatggaatacgtcgccatcgatgcacttgaacctgattggcacatttgggaaagtttccaaacctcagaagcatcatccgctttacaacgggatgcaactgacggtgttcaatcagtccacgtgcaagttaacaatcctgctgaaatcgacgccttatttgatggcgcgattgtttatgctaaaggcgcacggatgctcgtgatggtccgcgctttaattggcgacgatgcattacgcgcgggtttgaaggcttactttgcagcccatcaattcggaaatgcaacaggggctgacttatgggctgcacttggtaaagccgctaacttagacgtcggcgctattatgaattcatggctcgaacaaccaggttatccagtggtaacggctaaagtcgttgacggacaattaacgcttagccaacaacaattcttcatcggcgaaggccaagaggttggtcggcaatggcaaattccattgaagagcaactacgcggctgcaccattgttgatgactgaccgcaaattagtgcttggcgattacgcgcagttacgtgccgataatgggcaaccattccgtttaaatgtggggaacgaatcacatttcatcgttaactatgatcaaacgttattcgacgatattttaaaagatagtgctgaaatggcaccaatcgcgcaacttcaattgctacaagatttacgtttattggctgaaggacgtcaaattaattacgccgatgtcgttccagttctagcaccatttgctaaaagtaattctaacttagtggctgatgcactttatacagtggctggtaatttgaagaagtttgtcacagccggtgaaacaagcgaacaacacttgcggactttctttgatcaattgagtaaagcacaagtcgcacgcttaggttggacggttcaaccaacggataccaatgatgatcaattgatgcggccaacagttttaagtgcagccttgtatgctaagaaccaagcagcgattgatgcggcgcacgcattattccaagctaaccaagatcagttggcaactttaccagctgctattcgggtactagtcttgatgaatgaagtgcaaaactttggtaacgccgcgctttacagtcaactcttagaagcttatcgtcaaactagcgatgccagctataagaacgatttgagtgccgccttaacacggacgactgatcctgaattaatcaccactttaattagtaaatttgaagatgccggtacaattaaaccgcaagatttacgggcttggttccggggcttactcgctaacgatgcgagtcaacaagccacttgggattggattcgcaatgattggcaatggctagaagacacagtcggtggcgatatggaatttacaacttatatcacatcaatcgcggcagtcttcaagacgccagaacgcttagcagaattcaaagccttcttcgaacctaaattagacaccccaggcttaacccgggaaataacgatggacattaaggtcatcgaaagtcgcgtggccttgattgaaagtgaaaaagaaaaggttaatgcggcaattgcacaacaaatttagatggaagttattaaaatgaaaaagacaaacaagaaggttattttagcgattatcctcatcagttattttatgattttattggataattcaattatttttacagggacggttaaaattgccgccgaattaaacttaagtcaaacaacattatcgtgggtcacaaatgcttactcactaacgtttggtggtttgttattacttggcggcagtattggtgatattattggccgtaagcgggttttcatgattggactgacagttttcgcggtagggtcattattagttggccttgccaatagtgcggtgatgattattttagcccgagcatttcaaggcattggttcagcaatcttagcaccaacgactttggcactcttaatggacagtttttcaggcgaagcaagaacacgcgcgattgcggcttatggtgccacagctggtattggtgctagtatagggttagttataggtggtatttttgccagtctactatcttggcgggacggctttttcatcaacgtaccgattgcgattattatgattggtttaacggttcttttcataccaaccactcaagccacacaagctaagcgattagatttaatcggtgcactgacgtcgattattgggatgacggcacttgtttatagcctagttggccaacaaggccgcttactagcattgttagtagcagtcgttgcgattgccacttttatctggcaagaagcacgaacgaaacaaccaatgatgccattgtgcttgtttgctgattgcgaacgactagggggctatattgcgcgcttcttctatctgggtgcaatgttgagtatgtggtttttgacacctcaaattatgcaaacccatttaggttttacgccccttcaagcaggaattggctttttccccttaacggtggttaatttcatcgttgccttgcaggtttcaaaattaacaacgcgctttggtaataccaaattactaatcgtggggattgcaacgaccgcaattgggatgggggccttaggctttttctcagagcaagttggctatgcgctaggtatcgcggttcccatgatcttgatggggattggacaagggttaacactcagtccattaacggtcgccggtgttgccaatacgttacctgcagatgctggcgcagcttcgggcgtggtcaacatggtccatcaaattgggggttcaatcgggatgtcgtttattgtggctgtttcagcgacttttaaaaacggcctaacaagttaccacgtggcaatggggttagcgaccgttctcttgattggtgcgttgctcgcggtgatcggcttaattttaccaacacttaaaaaggagtctgaatgaatgatgaaaaaaatcttaattattggtgcaacaggttcaattggttcagaagttaccgcacatttattagacgaaatggatacgcaactcactttattagcgcgtcacgttaatcagcctaatcaagaacgcgtcacgtgggttcaaggagacgcgaccaatctcgtgcaactcgaaaaagtaatgcgtaatcaagatgctgtttttgtagcggtcagtggtcaattggcccaagtagccaaggcagtcgtgacaacgatgactaaattgcagattcataaactggttttcattgcttctatggggatttataatgaaattccagctagcattggtgcttcgggtaatttggcctctaatgggatgttgcaagcctatcgccaagcggcggatattgtcacggagagtactttgaattatactgtgattcgacccggctggttcgatcaaggtagccatgattatgaagtgactggccgcaatgaaccttttggcgggcatgacgtttctcgctgggcaattgctgatttagtccggcgggtgcttgaggacgagcaattatatgcacgaacaagtgtcggcattaaccggccacaataaatgaatattaaagaagcgagtcaacaaacgggcgttaccgcgacaaccattcgttattatgaaaaagagggcttaatcccagcgattgatcgcaacgatgttggcgtgcgagcgattgacgaccgaattattagaagaattaatttcgtaaagaccatgcgtgcagctgggatgagtatcgaagcgcttaaggaatatattcgtttatttgatgcccaagaagataatacagctcagcagtttaaactgttgaacgaacaaatcgcaattatggcagaaaagcgcgatgatcttcaaacggcaattgaccatctgcgctggaaggttgatcactatgaagatcatatggcagtcacggaagaagaattaagagcggttgaaaaaaatagagctgatcagtaaatgacaaatgaaacacaagaaatcatggcgttattcgctaaactcgttcaatcgcggtattttgtggcatcggcatggatgacggtcggcaaagaaagacggcgcgattttatgaatacgaagggtaaatcacgattgttgaatttattggccgctaaagatgggctaacgaatgctgaaattacagaattactagatattcgtcctagttcagtgagcttgcaagtcaaggcacttgaagaagatggctatgttacacgccaagcatcagcagcagataaacgcgtttccctcattttcattacggataaaggacgggactcaatcgaaaaaggtgatttggaaactgataaattatcagaaacaattttggctggcttaagcgaatctgaaatcaatgaattacgagtgattttaagcaaaattgctaataatgtacaaaaaacacagtttgattcagcctttttcgaacacgggcaccatatgcatcatcaaaatcacggcgattggaatcgttcacgattcccttggtagatgcaacaaatgagagtcgcaccatctaaaagtcaatttagtttcaaagattttctgggtttaattaagaatacaaaacctaaatattggcagttgttcttgggtttagcattagggctagtcgcaactggtgttcagttagcagtccctagttatgctaaacaattgatcaatagtttttcaaaacaatttaatatttacatgttgattgggattgttgttttattcatcttgagtgcggtgatcagtgccgcttcgggatcgctactcggctttttcggggaggatgttatccagaaattacggaataacatttggcataaattattgcatcttagagtgagttattttgatgacgtgaagtcgggcgaaatgacatcacggttggtgaatgattcaactcagatcaaagatttattatcacgatcatttcccgggttagtaacagccattttcacaatcgtgggagcgttcgctattatgctcttcatggattggaaaatgactttaatcatggccttttcagtgccattggttatggctgtgatgttaccaattgcgaagaagtcacatgccattggccacacccgccaagatgagttagcgcgtttcaacggcgaaacggatgaaacattgagcgaaatccgcttagtcaaatcatcaaatgcagaacaacaagccagccaacaagggcaaacagctattggtagcctttataagattggtttacgggaagccatttatgattctgttgcgggtccgattatgaccgctgtcatgatgggcttaattgttggtattttggcttatgggtcagcgcgagttgcccaaggcacaatgacaattggcgcgatgttctcatttttaatgtacttattccaattaatggggccagccgcaacactagggcaattctttacaacgctctcaaaggctagtggttcgacagaacggattcaagaattgatgcaagaatctgaagaagattttgatcatggaacggcggtagatgtcgaaggtcaaacattgaaagttgaatcagttgattttggttatgaagatgatcaaacgattttacatgatttatcatttgaagcgaaacctaatacggtagtcgcttttgcaggcccttccggtggcggaaaatcgacaatcttcagcttattagaacggtattacgaaccaaatcagggtgcaatcaagattggcgaaacgtcaattaacgatgtttccttagcagattggcggaaacaaatcggtttcgtcagtcaggattcagctattatggcggggacaattcgagataacttaacttatgggttaaccggcgaatacgcagacgcacaattatgggctgtattgcagttagcttttgctgaaaagtttgtgcgtgagatgcctgatggtcttgatacagaagtcggtactcggggtgttaaagtttcgggtggtcaacggcaacgattggcaattgcgcgggcctttttacgtgatcctaagattttgatgctagatgaagcaacggccagcttagattctgaatcagaagcaatggtccaaaaagctttggaaaccttgatggaaggtcgaacgaccctcgttattgcgcaccgtttaagtacgattgtcgacgcagatcaaatttacttcatcgaaaacgggcacgtttcaggggctggtaaacatcaagaattagtcgccaatcatgaactctatagagaatatgtggagacacaatttaatcaagactagatgaatgaattttacctagtggcgctactgttagtcggcgtcatcgtggtcaacgtggttaagcaacttgtaccacggataccagaagcctttttattaattgcgatgggttggggcctatcgtttatgccagtgttccacaattttcagttggaacccgaatttttcatgttactgatcattgcgccgttgatgtttatcgatgggcaaaagcagtcgtttgctaacattcggaagagatttcagggcattttcttactctcagttgtcttagctgttgttacggcagtggtagttggcgttatgaccaagcaaatcgaggctcaatggaccttcccattggcgcttgcgctagccgcaattgtcacaccaacggatgcagtcgcggtcaaatcaatgaccggtaacaatgatatgccaaagggtgtcggtgaagcactcgaacttgaatcgctatttaatgatgcgaccgggttagtgatgctggaccttgctttgtcagtgctctcaaaagggacgttctcggttgttgaagggattggtcatttcctattcgtagctgttggtggggtcttattggtaatgcttcgctttaacttgaatcgacatggtaaaaatccggaattaacgacgattccgattagtttattgacgccatttgcgatttacttattagcagaacattttggcgtttccggaatcttagcggtggtcgcaaccgggattgaacataactgggaagctgatcgtttacgattaacatcaactaacgttcaactcacttcacgaacaatttggaatattctagcggatattctcaatgactttgttttcttaattttagggatttcgttaccagaagttgctcgaaatgtgacgcaaatgggttggcagggtgctgccgccttattaggggtcagtgttttagtctacgttgtcatgtggattgtgcgctatgtttgggcattacgtggggatagtgcttcaatttcagctttctttggtgatcgaaaaagtgatgagcggccattttttgcccggttattcgcagtcagtgggattcacggtacagtgacgttagcgatggccttttcactaccgaataagattgcagggcacgcctttccatatcgggacgaattaattgcgatcgcgactttcgttattttaatcagtatggtggtcagctcgattgtgttgccacgtatgttgccacaaaaacggaagcttatacaatggccgatttggatcatatccgcaataagatggtcgattacgttattttacaaatgcgttctcaaattgaagatcatgccgttcgcgaagcactaaatgaaacattctattaagcattggaaaaaggaagtattgtggcatacaagtcatcgcgtgattacgcatgaacaacaacgccgtttccgggatgcgcgaattgccgaaaaccctgaattgtcagaacagattaaacaacgcgaagtgatgcgggatgatttattagcacttaataatgaagtgacagatacgattgatcattatctcgatacggttctagaaaatcgcttgaagcaaaagcatagcgataatgatttcgtttatctggttcgtcgtacgatgaatcatttctgtgcgcacatcaaacatgattatcaaaagagtgcggcaacagtgccagatatcttatacgttcaagcattccaacatgagtatgatttcgtgcaacaaggcatcaatgctggttatattaaccaatcaattgctggtgtgttgtataccgaaattaatcaagcacagttattacaactgcaacaattccaagaaacagaagagatggcgttgattgaagcttaattattcaaacattttcttagtagcgcgcatcaatgtcttgatatcacgatcgtaacgtggtgtgtcgactaatttcgccattggaatcccagcaaagtggtaagccgcaatttcgccagaacgaacggcactttgttcagtaaaaatcatctgataaggttgttcaacaaattcaccagtgaaggctaagttggttgaatgttcagggatgacctctggacgatctgtcttggcacgattgttgaagagtgctgaagcatatggcatgtaaacaggaatgttattgatgatactgtccataatttcagcttccttttcgcggatattgattgggccaggatcgaccttagctaattgaccaatcaattcttgtaacatttccttaccagtcatttcgatgtaaggcttgtccacaaattcaccgctccgacgtggatagaggaagtaaccccagataaccgcttcgtttggtttttgagttgtgaagtgaggttgatggtgaacaacaatcgacatattaacatctttttgaccaagtggtgtgattggtttcgttgataggaatgagtttaaggcattccctggaatttgagtggtaatgcgttcgatttcgtttaataaaatatggtttttagtcgttaaagtaaaactgacccattcactggcattgcggtcagcaaagaatttatcggcattaccgaggttgtagaatttagaagcaatttgtttccacaaaccggcagcagcaccgtaatccatattttcaggagctggtgtgttgtaatcaccaagtgttgcagaatcagtgattgaaccgttcgtgaagataacagcagtatcgtcatcaaccgtgatgtgttcaacttcatctgtttcagtattggtcatcgtcataccagtaaccgtgatttcatcggtcatctgagtctctttaaagtctaaatcagtgattcgacggttgagaatgatgcggcaaccttgatcttttaagtagttaataagaggtaacatgatactttcgtattgattgtaacgtgtccggttaacaccgactaagtgttcaatctgtgtgaattcataaatcatttggtgcatataccggcgcaattcttgtgcggaactttgtgttctgaaagcaaaggttgtttcccacatgtaccagaagttagtttggaacatatgtggatcatccttgaagtattcggcaattgaaacattgtctagtttttcttcttcagagtcgggcatcataattaatttggtcattaataaccgatctttattattgaagccgaggtgaccagcatccaaaatacctttgctaccttccaataaacgggccttgtcgaacgtgcggtgttgcgcgtcgaatgaacgggtatcttcttcagctgtcatattaggttcagttgctgaaggaattcgacctaaaagatccattaaatcgacgtaagtccggtaattaagcatccggccaccacgggcaacgtaacctttagtattttctagtggatgattcttgttccagtattcatcggttgtttcggaaacaggtgcaccatcgtttgaaccatggtcatctaatgagtagaatgtaatagcatcaccagaccaaccgccttcttgaattaaatagactgctgcggccatgtttgaaaggccagcgccaatcatgattgcttttttcttgatcatttaacgactttcaaacttttcgtaatcaactgaatcatctctaaatagttccatttttttagcaactaagcaagcaccggtgactgtgatccctgcaagtacaagactgcctaataagaatttcttcatatgaacattggtcaccaaatcaaacaaaatagattgaaacgagaatggacccaagaatacttagcccagctgttgaatgtatcacgttcaacagtttcgagttgggaagttgggcgaaactaccccgatttagaaacgattgtggcgattagtgatttatttgctatttctcttgataaattattacgggaggacagtgtcatgaccaaagaagtttcgaaacggatgcacatgaacaagtattataaaatcgtcttgacgatgattgcagttattttattaggattggtgattagtaaccgacgtttaaaccaattggaacaacggtatcgggagaatttaacgcattacggctggcatcttgataaagataccagtccatatgccaacaatagtgcgtatgaacttaagacggaggatacgacctattacacttatatcctaccaactggttataatccaattccgttggaagaacgtaaggtgaatattatcacgcgacgaaatggacacgttgttgatgttttagatagtcagcatattaccgtcgtcttttcgaagtcaaatgatgccaaactaaagtatcaaggtagtggtcaagttaatctagcaggtgaattgattgctgatcaaccacggttaacgggtgctaagaaggcgtattttaaagcgtatttaaagcaacaccaaaagacttatcaagcattaattcaaaatagtcttcagaagaaacaagagatcattactaaacggtagatgcaaaaattatctgccttaacggccccaatggccttaagcaacggtgttacaattccaggattaggttatggcacataccaaacacctaacgaagaaacgaaaaaagcggtcttagaagctttatcagttggctatcgccatatcgatacagctgccgtttatggtaacgaacaaggtgtcggggatgctttgaaagaaagtgatattgctcgtgaagacatctttgtgacaagtaagttatggaatacggaacgtggctatgacgctactaaggctgcatttgcgaaaacaattgcgacattaggtgttgattatttagatttatatttgattcattggccagcaaataccaaacaatttggagctaaagcggccgaattaaacgctgaaacttggcgggcgatggaagatctatataatgaaggcaaaattcgtgcaattggtgtttctaactttatgccccatcatttagatgaactcatgaagactgctgtaatcaaaccaatggttgatcaaattgaagtgcatccaggctggccacaagcagaatctgtgcgttataatcaagcgcatgacattttagttgaagcttgggcaccacttggtgaagcaagtgctctttctaatgaaacgattgcggcaattgcgacgaagcacggtaaaacagcagcgcaagtttgtcttcgttgggggattcaacaaggtgtgttaccattacctaagtcaacccatcaagaacgtatggcgcaaaatactgacatctttgattttgaactaacagatgctgaaatgacccaaattagtgctttagaaaacttaggcggtcaatgcatggtgccagatgaggttgatttttaaatggcattatcaattggcgaagtcgctcaacagtatgatttaagcattccgacactacggtattatgaagaacaaggactgctgccgtttattaaacgcagccccgctggtcggcgtgaattccggcaagctgatttggattgtttatgtgatattgaatgtttgaaaaaaacgggcatgcagttgaaagacattaagcaatatatcgattggcgaaccgcgggcgatgaaacattggaccaacgcttggcactgattcaacaacggcgacaaatgttggctagtgagattgaatcattgcaagcagaattgacaaaactagatcataaagagtggtattacactaaagcaagtgaggctgggacagaggctatttttacagcggattgtgatacggaatacgaacgcgctcatcagaataagtagttaatgaaggtttaaatccttttgcataatcaaatcgcgttgcgcatcgtcaccgagttggaagatatgaccgccaatttgcttaaagcctaacttggtataaaaggcgagtgcggcagtgttgtgttcccaaacgccgagccaaatatgggctttatgggcctcttgcgccattttgatggcgtattcgatgagttgtgtgccaagaccaagtcgtttaaatgttggtaggatatagatgcgttcaacttccattgaatcaggattaggattttcggtttgggcatcgttactgtttaatttaaggtatcccgcgatattgccgttgtatttaataaagtagaaggctgaattaggattagcgatttctgaactaagttgcgtatcactgtaggcagattctagatagtcagctaaatcctgctctgaattatcagcaccaaaagtatcggtgaaggtttgaatactgattgtttgtaatgctttaagttgttttgaggtaactttttcaattgacatttaatagggccgctgttgcccttttttgacttgttcccagtcggcggcaacgttggtgctgactttggttaatagttcgtgtaatacctgggtttccgctgttgttaggccttgcagcgctacctgattggaataatcgttctcccgtttaatctcgggatagatggcttggccggctggggttaaatagagatgtttgattttgagattggtctcatcagcttggcgggtaattaacccggcacggcttaatttttgaatggcacgagtgacagtagcgcggtcaaccttaatcagttcgaccaggcgctcttgaatgatgcctggattttccgcaatgcgaacgagatagagatactggccacgggttaaatcgaattttttgaattcaatattagcaatcgaatctagtgagcgagcgatgacgccaatcggtcttaaaatatctttcacatgacattcaaaaaatcgattattagtgcagtgacagtaagtttggtaggggtaacaattgcatcaacgcaaccggcctttgcgagctcttcagccgcagctaaagaagccattcaaaaaaatcaagatgacgcgaaagcgctgttaaaacagattgctgccgctaacgaagagggcattaagctagatcaacaaattaaagataattctgccaaaattgcaactcaagaagctgtaattaaagaagcaactgatgaaattgataatctttcgactaagattgacgcagctaaggaagaagtggctaagcggacaactgtgttggaaggccaattaatctcacttcaaaagacaagtggcgacgctgttagtggcaacgtctatgtggattttattctaaattcagacaacctaacggatttggtggcccggacatttaccgttaataagttaaacgaagcaagtaaagaagcgttggcagatgttaatgaatctaaagcgaagttaaccgatttgaaggataaccaagaaaaagctaaagctaaacttgaagctgacaaagctgatttagaaaagcaaaaaacaaacttgttagacttaaaggacaaggtaactaagaatcaaaatgacttaacgaaaaaaattaacgataataaaaaagcattaactgctttgaaagcggattatgacaaagcaaacaaggcagaaactgaaaaagaactcaaggaattagctgcctcagctgctgaaggtgaaaagggaacggatagttcggttggcgaaggtaaaaaagcaatgagttcagcgggtaatgcttacgcttggggacaatgtacttggtatgttaaagctgttgcgccatgggctggtaatagttggggcaatgggaaccaatggggcgcttcggctgcagccgctggttttacagttgatcataatccagctgccggcacaattattagctttgctgctggccaaaaagttggttcatgggcagcagatccttcatatgggcatgttgcctacgtccaatcatatgatgcggataagaacactgttacaatctcacaaggtggcttaggctttggtagtcctgctggtcctaatacacaaaccgtttctaacgcgagatcattaacttatattcataaataattgcgacgattgtttaggttcttaaaagcgaattttcaggcattcggacggcattggagcgtctatgtattattggttgtgagtatcaatcttgttttgacgagtttaattgtgccgggactgacgtggggggtaaaccgtttattagtggttaatgggattggatatctgacctacacgaacttcgtttcagtattgactaaacacccgctcgttttaattagcttggttttgctggtgctgttgatttgcgggttagtctatattcaaatggcttttttattccggcaaatcaaacgaattcaggaacagacgccagcatcacagtggcagcttttaaaacaatccgggcatgacttattgactctgaagcccttaacaatgctgattatgattggttattttctgctgattctaccgtttgggcagattatttttaaatctgttttactaaataaagttaccatcccagcatttatcattcaggatatgtggaccacacctaagatttggggtcccatcattttggtttacacgttagcattgattctgtcgattcgcttaatcacttttttaccggagacaatcttcaataaaaaattatcgacaactcgactcttgcaaaaatgttggcaaacgacgagaggtcggttttggcgtctattaattaaggttggggttctagcaattgcaattacgctagtcggagttttaagtcaactactattctttaatctacaacgatattacgatcaaaatttaccgcattatgcactcttgttagcaattttaaatctttttatcctagaaattatcagtcagatattgttagcgatgagtattgtgatgattttacaactgatcttaaaacaggcaggttatctggtgccgagtgaaacacgcgttaaagtgattttaaaacagcggtcactgagaatacgaatgcgtcaaggcgcagcgatgttattgttgattttagttgccgctggtgtcgccttatacgattatgcttatttagaaggtgcgatggataacagaccagctttgatttcccaccgtggtgttgatgacggcaatggcgttcaaaatacgattccagcgcttcaaaaaacagcacgtgaaaaaccagattatattgaaatggatattcaagagacgaaggatcatcaatttgtcgtgatgcatgataataatctcgaagaattagccggcgttaatcggaccgttcatgagttaacactagccgaattgactacattaacggttcgcgagaatggctattcagcaaaaataccaagtttcgaccagtatctgactgctgcggaaaaggcgcaccaacgattattggttgaaatcaaagtttcgccccaagacagcccacagatgatgactaactttatcaaacggctaccagcgacggctattgaaaaagggcaatcgtatccattcgttgagttatcctgttgtggcggcgttgaagaaacaagcaccgcacttatttgttaggtggcggcgttgaagaaacaagcaccgcacttatttgttagttttaacttgccgtataacatcagttttccagaaacaccggctaatgcttatacaatggaggcgacgacattgaaagcagcctttatcaatcaggcacacgctggcaaccaagcggtttatgcatggacagttaatgatccagacgtgatgcaacgcttgttactgactgaagttgatggcattatcacggacaacttaagtgatctaaaagacgttgttgctgagaataatgatcatcccagttatgcgacaaggctcttaatctattcaagtcagttagctggtttcagtggcgaatccgaaaattaaatgacagagaagatggcaataagcgacaaaatactatacggtgggttattagctgccgcagggggctttgattcctatacttttttagtacacggacaagtctttgccggcttacaaacggggaacttaattttgttggggacgcatattggtcaaatgaaatgggcggtattaatgcaacacattacccctatcctagcttttatgttgggaacgattttaacgcgggttgtgcagcatcatttcaaggaagccgattccattaataagcggcaacgattgatcttaggcgttgaaattgccgttttaacggtgatcgccgggatctcaccatacatcccagacttgttggcgagcgcatcagtgtcgatgattgccgccgcacaattacaagaatttcgggaattaaatggaggaccattcacttcattgatgatgaccgggaacgtccggacacttgcagaaagtctctacgatggtattttcaaaaagaatgcacaagctcttgataaagcttgggaaattataagaatcattattagctttacattaggtgcagtaatgaccggtctttgtgtctcactattgggtgaacggacaattattttatcagccgtctttttacttgtaaccttattaattttacaggtgaatccccataaaaaaatctaaatgaaaaaatcccccctacttatcggtttattaaccattgcgttgctagcgggttgctcaaatcaacaagctaagcaaacagcgtcaactaaaaaagcgaccacggttaagcaacaaacaccaactaagctccaaccgaaagtgagtcttgaaaaggcacgtgagttgtttaaacagcagtatccaaacgcggatatttcagaatcgcagctaaaaaagcaactgaacaaaacggtttatcacttgacgggtttgagtgatactgaagaactagaaatgcagattgatagtcaaacaggtgatatcagccatttaacgaaagaaaccttagatactgatgaacaacatggtgtggctcgtcaaaaagagcggtttgatttcaaatcgttaatgacgcttgaagctgcccagaaaaaagcccaacactattttgatggcgacgtcttagaggcgacccttgaaaaagatgatggcgttgtttattgggaaattgaaggccatcaaaagcaccaaaagatgcaggtaaagatcgatgccacgactggtgaagtggtcgatactgagttagatgattaaatgaataaagttaagggacccaaaaagcataagttgattgaatatgctaacgggccatctctggaagaaattaatgggacagttgaagtacctgagggcaaaacattttggaaaacattgttggcctattcaggaccaggtgcattagtggcagtggggtatatggatccaggtaattggtcaacttcaattacaggtggtcagagtttccaatacctgttaatgtctgtgattttggtgtctagtttaatcgcgatgttgttacaatatatggcggctaagttaggcattgtaactcaaatggacttggcacaagcaatcagagcgcgaaccagtaaatcgttggggatcgtgttatggattttaacggaactagctattatggcaaccgatattgcggaagttattggggcggcaattgcgctgtacttgttgtttaatattccgttagtgatcgcggtctttattacgattttagatgtcatgctattattattattaacaaaagttggttttagaaaaattgaagcaattgttgtggcgttaatcgtcgtcattttcgtggtctttgcttatgaagtggccttatcaaatcctgattgggcaggggtaattgttgggttagtgccaactgctaaaacattcgcaacgacgcccaatgtcggtgggatgtcgccactaacaggggcgttaggtattatcggtgctacagtgatgccacataacctctacctccattctgctatttcacaaacgcggaagattgatcgcaacaatgaagaacaagttgcgcaaaccgttcgtttttcaacatgggattcaaatattcaattgacgatggcctttttcgttaacgcgctcttgttgatcatgggcgttgccgtcttcaaaacgggggcggtcaaagatccgtcattcttcggattatttgaagctttatctgatacatcaacaatgagcaacgggattttagccagtgttgcgcggactgggattctatccaccttattcgcagtagccttgttagcttctggtcaaaactcaacgattactgggactttaactggccaagtgatcatggaaggtttcgttcatttacggatgccactttggttacggcggttagtaacacgcttgttatcagtgattcccgtattaatttgtgtcatgatgactagcaacaagccaccattggaagaacatcaagctttgaatacgttgatgaataattctcaagtttttctagcttttgccctaccattttcaatgttaccgttattgatgtttaccgatagtcgggttgaaatgggtgatcggttcaaaaactcactcgtgattcgcgtattgggctggttgtccgtcattggtttaacttacttaaatatgttgggcttacctggtcaaatcgaagctttcttcggcgatcacgcaacagcggctcaattagcattagcggatcatatcgcctatgtcctaatcgcagctgttttagccctattggtctggatgattgttgaattatataaaggtaatcaacgatttgaacagcaactcgcggcttaaatgtcaattttaaatatgagacgggtattagtcggcgtggatgattcagcagatgcgctattagcctttgaatatgcgattaaacgggccgttaaggatgatttagaattagttattgtatcggtgctggaaaatgatgagttgaatgtctaccaggctttgaataaagattatatccacggtcaatataatgatttggaaaaacatgttttagattatcaggaacaagcgcgggctgaaggggtcaaaaacgtcagagcagtaatcgctgaaggtgaaccaggcgaagtgatcattaaagaagtgattccaaaggtccaacccgatttattgattatcggctcaaaagcaaaagaaggcatcgcgaaatatttcgggagccaagcagcctatatggctaaatatgcaccggtaccagtattagtggtccgttaaatggatgaagtagctgaattttgggataattttgcggcggaatactatcaaattcaaaaggaatcgcaagtgccgattgtgaccgatattgaaaaatttttaacagaacagcgtttgttgccaaccaattcggttgtcgatttaggcggtggtagcggcaggtatctaccaatactcgcgcaaaatagtcaacaatacacaattgtggatatctcagaacagatgttgcgttatgcacaggtggaaaaccaagcgctatcggagccgcgatcagtgacttatcaacaacaatcggtggccgatttttgccaacaaaccccagatcaaagttatgatttagtgtggatggcactcaacccggcggtaacggcggacgaaacactactcaacattacgcaaaaaagtcggcagtggtgtggtcttttacggctaacgcagaatagcgatgatttatttgcgccactggaacaacactttgggattgctgaagaaaaccccaatatcgagccaacgattatcccggcggtggctaaactgttaacaagtgctggctatcaagttcggcaacaaaagtttcaatatcaaacaaccgagactttcgaccgggcatttttagaagcttattatgcggaagtaccgcaagtattgctaaaggcttatttggaccgattattcatcgacaaaaaaacacgtgccagtacgacaacgcttgaatatacgttgttgtattggcacgtgtaattagaagccaagtgcaattaagccagttggcaggttttcaaccggtacgggataaagcgcaagaccggttttaaccgcggccaccagcaagctgttgaggactggtatctgatcagcgctaatggttggagatggcgttagtgcggtgggcacaattagtgcggtcaattgccggttgttgatccgcgataaaataatatcgggattccccaattcaggatcgctgtggtaagtgttagttgctcgctctgctaaagcaagagcttcttgacgtaagctgtgacggccatcttttagtaaggtggttagtaattcatcatccgtcaacgattctggagaggtctgaatggtttggtctaattggtaattcacgtttgttgcgagttctttgaagagattgagattaccaggtaaggtcaccacataaataggggccttttgtgggagtagttcggtgagatagcgatcaattacgcggaaatagttggtttgatcgatgagttgttcattatccttgaccacgtaactgtgggttggacttgagaagccttggaccacttcacctttacggtcagtcccaatgcctttttcaatcgttgttggcgcatcagctggtaatgggtagtcgcgaatcacgttttgttgaatggttttaagactgaagctcgttttgttgaggtttaaaatcgtgccatttaaactgagggccagttcggaacttaatggccgtaaatctggatgcgcatcaatcgtaaagtattcgctattaattggataatgcaaaatgagatggtagcatttattctcagtaatatagaaggcaattgattgcacatgagcgagttcttggggggcaatcgataagcaggcttcaacttgttttaaaaggcctgcttgatcgggatgattggcaagtagttggtcacgaatctgtttagcataactattcagttttattttgttggcgctaagtgcttgaccacctgtatctaagttaatgaataatgaaacaacaggctgacttgaatctgtgagtaactgcgttaaactatctggatataacatatgaagaaacaaacggcaacagttacaccaaccgcaatcagtaaaagcattagaacgcgtttttttgttttacaaatggtggtcattctcgttctcggaagtgtcaccgctaaaatcgtaagtggttttaacccgttaatgacggattcggaaattcttaataagacaatcttgatggccttaggctcaacggtggtcgcattgattatctggtatgtttcatataaattaattgctttccagattaaacgccaagttatggataaggaacttgaagatcgctatacttttaatttatctcatgctgctagcagtttaagcttacacattgtttattttatcagtattgtcgtgattgtctggttaatgatgagtgcgcaaagtgttcgggctgatttagacgggctgaacctatttaagacggatcaaccaaccgttaaactcgttgaccaacatagtatgaaacagattaatcgcttctataagaagacagataatcagtcagttcaatatttagggagtcagcaagaccgtgcttatttcaaagtagatcaagcaaccatcagtttgccactttctaaagttcaatttaatggtcaagatcaaggaaaagttaaaaatccattgaagattgaaacttatcaattaaaacaaccggctaacaaaaaatatttaaaaccaactatttatctgagtcaaaaaggcttgccaacggtgccagtgacgaagatgtatcagcactacacgccaaaatcaagtgaaactgttcaaaaattagatattgagtaaatgattgaagcagtaaatcttagagcaggtatgacgtttgaacaagacggcaaattaattaaagttttggaagcaaatcaccacaaaccaggtaagggtaatactgttatgcgtgtgaaattgcgtgacttacggactggttcaattgttgaaacaacaatgcgcccagaagttaaagttgaacaagcaatgattgacactaaagatgttcaatatttatatacacaagataacgtggctttcttcatggatcttgaaacatatgaacaatatgaaattcaaacttcagccattgaagcagaattgaaatacctattagaaaacatgaactgcaagattcaattcttcggttcagaagtcatcggtgttacgttaccaacaactgttaacttacgcgttgttgaaacacaaccttctattaaaggggcaacagttacaggttctggtaaaccagcaacaatggaaacaggcttagtggttagtgtgcctgatttcatcagtgctgatgaagtcttagaaattaacacccaagaaggcacatacgttaaacgtgcagcaaaataaatgacgaagaaaataattctcgattgtgatcctgggcatgatgacgcagtcgcaatgatgcttgctcacgggaatcctgaaatcgatttgctagcggttacgacagttgctgctaatcaaacgttaactaaggtaacacgcaatgcattagctgttgcgacaatgattggtatgcatgatgtgccaattgccgctgggtgttcacgccccttgattgaagaaattaaggttgcagcagatatccacggtgaatctggactagatggcgttgttttgccaaaacccactgtcgaacttgaaaaaattcatgcagtcgatttaatcatcgatttaattatgagtcatccagctaaaacaattacgttggtgccaactggtgctttaacgaatattgcgatggcagcacgcaaagaacctaagattatcgaccgggttaaagaagtagtcctcatgggtggcggttaccacgaagctaatgcgagtgctgttgctgaatttaatattaagtttgatcctgaagccgctaagattgtcttcaatgcgggctggcaagtcacgatggttggcctagacttaacccatcaagccttagcgacacctgatattgtgtcagaaattaaggccatccatactgaaacatcggcatttgttgtcgatctattggccttcttccgcgatatgtacaagaagggccaaaacttcgatgctcctccagttcatgatccatgtgcggtagcctatgtgattgatccaaccgtcatgactactaaaaaagtcccagttgatattgaactcaacgggacattgacgcgcgggatgactgtcgctgatttcagctatccaatccctgaagattgccaaacatcagtcgctgttaaattagaccatgctaaattctgggggctagttgaagatgcgttgcggacgattggctaactaactttctaagtaacgggttacggttttaagaagataatcttttgacaataacgggttaacgcttttggcgctttccatacaaattagggcagcggtgtaagcgatctgtgttgttttttcccaacctaggttgtttaagcggctatcaactactgcggctgttaacgcggcactggcgccattattgttaacacgcttgattggaataccagcgattaatttagtgtttcgattatcaatataaaataatccagtatgaggcattagaacataaatatgttctatgcctttttttagtagctttttggcacttttttcagcagttttagcatcagtcacagatgagttagttagcattgcaagttctttatcagttgtcattaatgtatctattttagaaagtacgttttgtaatttataacttttattgagtgaaacagttttaacaaaaataggtactttgcaattgtcaaatagccagtcgattgtcttttcaggtaggttagtatcaataatacagtaagcggaagtattgattgtggctagtcgttcactaaggaaatcgggtgtgatatcgtcataaattcccatgtcatcgacacctacattcagggtgccatctggatcattgacgtaaagataagaagatgtacttttatcaggtattttttttgaatgctggatagcgagatgatttttttgagcatcttcttcaaatttttgcccattcagatcatcaccataaaccgtaataaaataatttggcactgcaagttttgttaaattatgggcaatattataaccagctccacctaaagagaaagtgatatgcccaggattagaattttgttgaataagtgttgtatcggttaatcctaggatatcaatattaacgccaccaataacggttacaaaatttggctcgttaataatataacctttgccggcaatgtaaccttttttggtgaggttaaaaatatgggcagcaacgccagatcttgttaaaccgaatttatcggccagttcttgttgtgaaattaatggattttctttaattatttttaaaatttcttcttcgcgttttgtcatatggaagataaatatgttgtagtcgttggcgggttgaatatggatattgcaggtatgccaggcaaggattttattgaacgtgattctaatcctggtgaggttaacctatccgttggtggtgttggacaaaatattgcacataatctagccaatttaggtgtaccaacgtatctgatgacggtttacggagacgatcaatacggtgcaatattacatcgagaatgtgaaacaaataagatcaatttagattatgcagctgaaattaaaggcgctaatagttcaacctatctttatgtaactgatggctcaggagacatgttagcggcaattaatgatatgagtatcgttaataatattactcctgattttttaaaggaacgattagcggtaattaatcaggctactttatgtattgtagatgctaatattccacaagaatcaattgaatggttggcagatcatttgaaagtgccgatgtatgttgatccggtttcagttgctaaagcacgtcgttttgaaaacgttttaaatgaaattgatacgtttaaacctaatgaaatggaagccgaacttctaactggaattaaaatatccgatgaaagctcagctaaaatggcagcagaatatttagttaaccaaggaattcgtcatgtctttatctcgcttggcgcacacggtattttatgtgcagatgaaagtcaaacagtactagtgccaattattaaggtaccaattataagttgtaatggtgctggggattgtagcatggcaaccattgcttgggcatattatcactttgggaaaaaggcttctttaaaagagattggtcaatatgcacaagctgcttcaagtattacggtgggaagtgcttcagccgtttcatcacatttaactgcgcaaaatgttattgatcgttgtcgacaagtagtaaaaaattaaatgattaaaaaacaaatttattcacttattacttatgatgaaagcgtaaaaacgatggaggcaggtgccgatcatattgggcttgtaccaatgcaagatggtggtgtaccagcgcatcgagtgccattagaaactgttgataaaatttttgctgaagccaaaagacgtggcgttgtaacagtggcaatcatgttgaacaaagatcctaaagaaatgttagatattgcgaaacgggttcgtccagatatcctgcacattgctgggatggaatatactgcagatcaagcgtttagagatcaattgagagcggtttgcccggaaacagaattaatgcaagccgttttagtagatggaccggaagcagtggaacgtgctaaagaatatgcaaaattctcagattacttattaacagattctggtttagctgcagatacaggaattggtgctagtggattaacacatgactggtcaattgatgcggcaattgttgctaatgtaaatattccagttattattgctggcggcttaggaccagataatgttgaagagtgtattaaggaaattaaaccttatggcgttgattcattaacaaagacaagtattaaatatgatggcggtcatatggaaaaagatatcgataaggtgcgtgaattctgtgaaagagcagataaggctgctgcagaagttggcttataaatggcaactgcgatcattggtgtatttttagtctgtgttggagtagcgattaataacaacacacaactaggtaatgatccggtcggaattatttatgatggtattcgacaagctgctcagctttcacatgcgcagttaggcgtggtttccaattatattaatattggattgatcattattttgtttttctttggacggaaatatattaatgtcggaacacttatctatcttgtaccctatggcttttttatcagcataggtagttatctgtataccgtcgtttttgtaggtaatacgctatggatacgagggttagctggtctagttggttgttctttatattatctagggattagcctatttgttgctagtaacatcggtgtcgatccttttaacggattaatgttaacgctccgggacaaaacaggctggagtattcgccgttcgaaaataacaatggatgttgttttgattattgctggtgttttattgggtggtcggtttggcgcaatcacaattctgacggcattaacaacaggactagcaattcaatatttaagccaattatttagccaattgttatacggtgagagaatttagatggattataaattagttcaaaagaccaaagtattagtaaccgatgatttacctaaaacgattttgggtattttgaaagaaacacaatataaaaggccattaattgttatggatagttttttaaaagaagttgcaattgtaaaaagattgcaagttaaattgacggagaacaatattcaattctctgtctatgataaagtcgtttctgatccgccaacaactgtggtggatgagggggctgaattctttaaagcgcatgattgtgatagcttaatcgcaattggtggaggcagtgccattgatgttgctagaggaattaatatcgttcgtataaatggtggcaaaattagcgaatacgtcacagcaagtaacgaaataaaagattgccccggactgatagcagtaccaacaacttctggtacgggtagtgaattatcgaatgcattaatcgttacggatacagaaactcagaccaaattagcggtattagcgaataacgcagttagtgaatttgccgttttgaaccctgaattagtaatgacattacctaaagggatgacaattgcaacgggcttagatgcattttcacacgcggcagaaggttatacatcaaccttagcgagccctgtcacagatgcgatttgcgaaaaaattatgtatttactagtcaaatacttacctaaggtaattgaagatggacaggatcgagaagcacgtgaacgtgtgatggtcgctgctacacttggtggttggatgctaaataatgcagggacacatgctggtcattccgttgcacatgtgattggatctaagtaccatatgccccatggaatggcttgtgcttatgcgttacctggggtacttcaatttattgcaccagttagaagtaaaaaagtaaaagaaattggtttgattttgggcgctgaataccccgcagatccaacagataccgaaatcggtagaattacggctattcaatatcgtgaatttagagataaagttcttgggatgaagccattcactgattttaatatctcagatgatgaattgctaactaatatagaaagtgtcgttaatgaacgttttgcgggaaatacacctaagcaaattgatcaagagggcgcaatgatgttattgaaaaactttggctagatgagtatattaatggggatagtcggattagtctttatatttgcgattggttggttagtcagctccaaccgaaagaaaattagatataaacaaattggtattttattagttacccaatttgtgatttccttcctgtgtttacatacatcaggtggggttaaagtgttggcaggtatttctaatttctttagttggttaatggggcaagctgcaggtggcgtcgattttgtttttggtggcgttgtaattaagagtggcgcttcagtcttcttcctcaacgtattgatgccaattgtatttatttcggcgttagtcggcattttgaactatattaaggtcttaccatttattattaaatggttaggaaaaggcattaataaattatcaggaatgggtgaattagaaagttattttgcagtttcaacagctgttttggggcaacctgaagtttttctaacaattaaggaacgaattcctaatttatcaccacaacgtttatatacaatctgcgcatccgcaatgtcagcggtaagtgcggcaatgttggcttcttatatgaaaatggttcccggtaaatttgttgttgtcgctgttttcttaaatattttttcagcccttattatttcatgtattgttaatccgtatgaaccagaagtagaggatcaaaaaacgatagaagctcatctctccactgaaaaggaaccattcttccaagttttaggtaattatattgttgatggttttcaacttgccttaaccgtagcagcaatgttaattggatttgtatcattagtaacgtttttaaacaatacatttggctttttctttaatgtcactttcacggatattattggttgggtatttgcacctgtcgcatttgttattggtgtgccagctgacgatattgttaaggttggaagcttaatggccacgaagttaattacaaatgagtttgttgcaatgggtaatttatcacagatcgcacattcattgagtccaaaagcaacggctattatctcgacttatctagttagttttgcaaattttggaacgattggtattatttcaggatcaatcaaagcaattgataagaaacaaggtgctgttgttgcgaaatttactatgaaattattgttaggtgctacaatggcttcaatgctaactggtacgattgttggtatgtatttttaaatgtataacgcaaaagcaacgcggtatgacgatatgatctaccggcgtgtcggccattcagggctgaaattacctgcaatttcattagggttatggcataactttggtgaaacagataaagtggctactcaaaaagaaattatttttggggcctttgatatgggcattacacattttgatttagcgaataattatggtccaccagccggtagcgcggaagaaaactttggtcggattttgcactcagacttgaagcaataccgggatgaaatgattatttcgtctaaggcgggttattatatgtggcccggcccttacggtgaatggggttcaaaaaagaatttaatcgctagttgtgaccaatcattgcaacggatgcaattagattatgtcgatattttctatagtcatcgaccagatcctgagacgccgattgaagaaacggcgcgggcgttggatttattagtccatcaagggaaggctttatatatcggaatttccaattattccgctgaacaaacaaaagcgattaccaaaatttttagagaacttggcacaccatttattattcaccaaccacgttacaatatgttggatcggtggattgaagatggcttaaccgatgtgttggctgaagaaggtttaggcgcaattacgtttagcccattagctcaaggcatgttgacgaaccgttatttaaatgggattccagcggattcacgtgctgcccgtccggatagtccattcttatcacctgaaaaggtcgaccaaacaatcagcactgttcaagaattgaacaaaattgcgcaacaacgtggtcaatcattggctgaaatggcgcttgcttggaacttgcaacaaccaaccgttgcgagtgtcttggtgggtgcttctagattgagtcaacttcaagatagtgtacacgcgttagataacttaacgtttgcacctgaagaattagcggccattcaaaaggtattaaaatagttattcagctgtttctgcagttgctgcgtttgcttggattttgccaagaatcgcacgtgagaatggtcccactacgattaattgaagtggtaaggcaacgataatgttcattgcccaagcgtgtctgtaagcaccgccgagatcgtttggaatcccaccttcgattaatacaccgaagagtgacatacatgtgaccataccaagaatcatcaaacatgaaattgttaaaatcatgactaatttattgtccttattaagtggtaagctgaatgcgatctttttagcgagtacgccgatcacgaaaacatcgaggatgaaagctacgatgaacccaggaatcaagccggtgattaaagcgacaaatgaaaaactcccgtgtaaaaataagttatagatactcattccaagtaccattgagaaacacattaatgttgtaaaaataataccttcttttttattggtaggcattcacataaaaaattttggcgtaagtttttttttcagaaaatgagaagtttcttcattttcaatttcgatcggaatttcaccgttatggacggcatggaaaatcgaaacgagtaacaatgcacagacaaaaatcagtgggaagcccgcaatcacacaaaccgcttgaacggtttggaaactgccgacgagcacaattccgagtgaaaataaaatgaaaatgacaacccaagccatccgattccaacggttaggttgttcgccaatcttcaattcaagactagtaaatgacgaaacgatgaaggctgatgatgaaatggttgtggctaggaaaatgaaacaagatagacagaaaatcgcgagcatgacaatcttccaaggaagtgtcgtaatgacggccgcgataacggcggcttggccttgtgtgttcaataaagtaacaaggtcaacttgaccggaactttgtaagaagagggcgtaaccgccgaggatggcgtaaaagctcatacaactaagcgcaccataagtggccatcccaagtagcacttggcgaatagtccggccacgagagatgcgggcgatgaacaagcccatcacaggcatgtaagataaccaccaaccccaataaaagagcatttcgtgttgggcgaaatggctatcagaaccagttgcgtttaaactgagttgcccaaatttaccaaatagatggaaaagattgtgaccttcagcaccaatcagatgacgggtggggccgattaataaaacgagtaataaaaagccaatcgcggtgtaaatgtgccaagcgctcagtttcttgatccctttatttaacccagcgtagacggttaaagtgaagagaatgaataaaacaacgaacaaggctagttttaaccagatagtatctgaaaaaccagtcatcgtgctaaggactttagaaatgacggggatttccatcccaattgaagagccgattccgcccataatcccgaagacgacaatgaagtcgatgagttggcggagaacctttttgtaagtttgagggccttctaataaatcgatggcggcactcaagcgttgaacgcgtaaattcttaacatagagtgcatagccaatcgcaattgtggcggtggcaaaaatcatccaggccattggtccccagttaaactgaccgcagacgttagcgtagcggtaagccgctgctgaaaagggcttagcgccaaatggtggattttgtaagtattggagtggatccgtggtgctgagcattaagatgctggcatcaatcccagtggcaaaaaccatgctgccccattgaaaatcgttatattcaggtttttcgttaggttggcccaaacgaatccggccatagtgactacagcccaaccaaactaaaaagatgaagttaataatataaatacctatgtagagccattgggaatgggacgtcatcgtgtccaataattgcgaaatagagtgctggagtgtgtcacctcctaacattagaaatgcggagacaatcccgaacaataacatttagcgatcagcggtggcaagccattttaggtaatcctgttcacgattaatcgcatgttctaaaatcagatagtggccatagttggcagtaatcgttgcttggttagggaagacaagcgctttgcgggccaataaatgggtgagcttatcagtgtgcaaggttgtttgttccgcaaacatagcaggtaaatgttgatcattttttgattcgataaaatagagtttgaggatgaattcgtccttgctagcgagaatttcactggtgggtgagtagcgccactcgttgaaataactaacgccactaggggtaatcgtgtattgtttcttcttgagtttagtgccagaaatgagttcgatatgggtaatcaggtcttcggtttcgaggcgttttagttcaggatagatttggctgtgtttggcctgccaaaattcaccaatttcattttcaaaaacgcgtttgaggtcgtatccagttttgggcgcctgatttaatagaccgaggagcaagtactggagaatatttttctgtgccatatggctaagaaatcaaagattgcaaaattagcaaaacaacgcgcgttggtcgcaaaatatgcggatctacgcgcgactttaaaagcggaaggcaactacgctgctttagcagaactaccaaaggattcaagtccagtgcgtctacgtaaccgggacttaattgatggccgaccaagaagttttatgcgtaaattcggcatgagccggatcaatttccgggaattagctcacaaaggccaaatcccaggcgtcaaaaaagcaagctggtaaatgaaaaacgtctcaaaaaaaagtccatcaattctattaatgattgtattggtgggatttccacaaattagcgaatcaatttttacgcctgtcttaccaatgattagtcaggcctttcatgtcagtgcgcaaacggcacaattgacgatgagcacctattttatggcctttgcctttggtgttttattctggggttggttatccgatcagattgggcgacgactaaccatgttgttaggcatcggcgtctatctgtttggtaatggcggcctgttattagccggtcattttagttggttaattctagcgagattagtacaggcttttggcgcgagtgttggttcagtggtgacacaaaccattatgcgtgaatccttcagtggtgtgcgcggggcccaagtatttgccaaagttggtgcggccatggcacttgcaccagccttaggcccgttgattggcggtcttgtccaaacctattttggttatcgccaagttttctcggtgttaattatgatggcggttggcgcgattttatacgcgggtgcatgtttaccagaaacgcggccagctggtgtgccggcacaggtcaatatcggggcagtgacgaaacggttactaacggataaaaaagtctgggtttacggggccgtgattagcggcatcaacggcattctattcagttattatgcttaagtgttagccgctgctagcattttaggcgcaatgactaccaattacggcgcacccaagtttggggcagtcatgatggctaaaattggcttagtgcttgctttagtagggagtctgttattgttggttgccagttattatgatcagctgttgttgatggtcattttaattctaatcgtcttttgggggttaaatacgactttaccagttgttttaaacttggcattagtcggttatgaagcggtgattggcactgccagtgggctatttagttttggttattaccttgcaattagtgctttgacttacggcatgagtttgttgcatacaggcgcaatcagtcgattgccattgtatatcgtaacgattgtcgctgtgatggcactttggtacgggttagtaattcgaaataacgaagtgtaattaagaatggcgttgttgttcaaggccagcgagaaaaatatctaagcccaacatgaatttttcagcggagtgttgctgttgttgccggtggtgttcgaacgtttttaaaaaagcgtcaaaatgattatcggcagcgattgttttcatcttcagcgggagttgtgcgagataaggatccgtttgactgagtgcgcgttgcttcatctcaatttcccccgcgatatcggcgaagagacctgacatgaagtggtcgatggattcgatcgccagattactttgttcgggtgtgaagccggcgtctaataagatttgtaagaggcggttaatgagactaaggcggattttggtcgcagggacggtccgcaacattaattcggctgcgtaaggctgttcaaggtaggtggcataaattgttttgaagatcagcttgatttgttcagtccaaggcatagccgtcgtcgttggtggaaattgaatcccggcgataatctcgtcagccattgcttgaaggagggcctgtttgttttcaaagtgccaataaaaagtcgcgacaccaatgtggagcttggccgcaattttacgaattgagagctgttcaactgtcccgcctgtttgcataatttcaaaggcagcggccgtaatttgggctgctgaaattgtttgtttaaccatatgtcgttattgaaacagcacttgaagccatatctaggcgtttttagcctatctatattagccaccattatatctgttgcgtcttcactatggcaaccaaaactattacaaaacgttttggaaggtattatgaaagacgaccaagataaagtgatgcaaattgggatttatctcatcgtgattgccgttgtcggtttaattgctggggtagtcaatacgattacgtctgcgattaccgcacaagggatgactgccgatattcgggaaacgacctttagaaagattcaaactttctcatttgctaacattgagaaattctcagttgggaatctttcggtgcgcttaacgaatgatatgacccagattcaaaatgtgattatgatgtctctccaaacgttggttcggattccgattctatttgtcggcagtttcattttagcgatgaactcaattccgagcttatggtggattatcatcctcttagtggtcctcgtttttgtgattacctttttatcaatggggtcaatggggaaacactttggtgcgattcaaaatttaatcgataagattaacaacctcgctaaagaaaatttaatgggcacgcggattgtgaagtcctttgtccaagaagataatgaaattaatcgcttttcaaaaaccagtgatcaattagaaaaacatacggcaattgtcgggatgctcttttcagtgatgattccttcatttatgttggtcgctaacttggcagttgttgcttcaatctatttcgtcggtaacttagtcgatacagatccggaagcaatcgccgcaattgcctcatttatgaactacttaatgcaaatcatgatgtcgattattatgggcggcatgatgatgatgatggcttctcgtggggcagtttcgttgaaacgactccaagaaatcctcgccacagatcctgacattgtgtaccctgatgtgccagatcaagatttagctgggaccctggcttttgagcatgtcagcttccgttatccagaagatgatcatgatacgttgaacgatattagttttgaaattaatgcgggtgaaatgatcgggattgtcggcgcaactggtgctggtaaatcaacgatggctcaattgattccacgtttattcgatccaacaaaaggtggaattcgtattggcggggtcccaattaaggaattgaacgaacataacttacacgattcagtgtcattcgtgcttcaaaaagcgattcttttctcaggcacgattgcccagaacttgaaacatggtaaaaaagacgctgatacggctgatatggatcgcgcgactggcattgcgcaagctaaggaattcatcgagaaattagccgatacgtatgatgcaccggttgaagaacgcagtgccaacttctcaggcgggcaaaaacaacgcctttcaatttcacgtggtgtgattggccaacctaagattttaatcttagatgatagtacgagtgcgctggatgctcattctgaaaaactggtaaaagaagcccttgatcgagaattagccgatacaacgacgttaattattgcccaaaagatttcatcagtggttaatgctgatcgaatcttggttttagatgaaggtcgcctagtcggtgtcggaacgcatcatgagttgttagaaacaagtgctgtttaccgcgaaattttcgaaactcaaaagggaaagcgaggctaaatgaaagaatttaaacgtgccatggtctttttctaccattatttaaaacgctataaaccatcttttgcgattatccttgtgatgaccgtctttgccacttatttacaagtcaaggcgcccgaatatattggggatgcactgaatgaactggttaaatacgccacgaagtttcaggttttaaaagcccagcatttaccaaccagtggggcttctaaagatgcttttattgatgtcattgtgtcgttagtccttttttatgtcttgagttcagcggcaacctttgtctcaagcgccgctttttcacgcgtcaatgcgttatcgaccaaccggatgcggattgggttattcaataaattacaaaagatgcagattaaatattttgatcgtcattcagatggcgatatcctcagccgttttacgagtgatttagataatatttataacgcgatgaaccaagtgttaagtcaattagtgtcgggaacggccttgttgattggtttgttaattatgatgtttagaaaagatacccaattggcgtgggttacaatcgcgtcagtgccaatttcgtttattttagcgtggatcattatcaacaaagcgcaaaaatacgtcaatgtgcaacaagatgaagtgggtaagttaaatggttatatcaatgaaaaaatcacagggcaaaaagtgattattaccaacagcctacaagctgaaacaattgacggctttgttgaacataatgaaagtgtccggaaagcaaccttgaaaggccaaatttattcagggatgattttcccattgatgcaagggatgtcactggttaatacggcgatcgtgatcttctttgggagctggctagcggtcaacggggatatcaaaaaatccgttgctttaggattagtcgtgactttcgtgcaatattcacaacaattctataatcaaattgcgcaactctcatcaagttacagcatgattcaattggcaattaccggtgcgcgccgggtcaacgaagtctttgatgaagatgatgaaattcgtccaactgatggacaacaattcaacggaattgaacgttcagtaacgatggaacatgttgattttagttacttaccaggcaaacaaatcctgcacgacgtgaatattgaggttgataagggccaaatgattgcgttggttggaccaactggctctggtaagacgacggtcatgaacttgatgaaccggttctatgatgtggatcaaggcgccgttaagattgacggcgttgatatccgtgacatggatttagacacattgcggtcacacgtggggattgttcttcaagaatcagtcttatttgcagggacgattcgcgataacatcgtctttgggaaaccagatgcgactgatgatgaagtgattgcagcggcgcaacaagcgcacattcacgatttcatcatgacgttggaagatggctatcaaacgaaggttagcgaagaagacaacgtctttagtacgggtcaaaaacaattgatcagtattgcgcggacgattatcacggatccagcgctcttgattttagatgaagcaacaagtaacgttgatacggtgactgaaagccatatccaaaaagcaatggaaaatgtgattcagggtcggactagttttgtgatcgcccatcgtttgaaaaccatcttaaatgcggatcggattatcgttttaaaagatggccgaattatcgaagaaggcaatcatcaagaattactagcacaagaaggcttctacgcagaattgtataacaatcaatttgtatttgaataattatgcatttaatgcattcggtaaggtgccgagtgcgctgagcgttaagcggtgtgtcgctcttgaaatagcggtgtagaggcggttacgtcctactgttggttcagtgtagtagtcattggttaagtcgtataacaagacgttatcaaattccaaacctttagcgagtgttaatggtaatgtgaaggcaccactttcggggagggtggtcgtttctgtggataagtggtggacatcttttaattttaaaaggcgctcatcaaactgaccggcgggggtgataatcgctaatgtttggtcagtaggcagttgatcaatttgcgtttgaatttgcgccaggtagtccgcgtcattagtcgcactcagataagttggttgaacaccgtgcggttggaccgcgtgaacatcggttaagtcagggaataactgactgaataacgcggtaatcgcaccggatgagcggtaactcgtccgcaatgcttgggtttttagattaggaaaaatcgcgggcagtttactgaattgaattttatgaggtgtaatactttgatgttgatcaccgaagatggtgaattgcgccttggggaaaagctgtttaaaaaggtgtaatgtgctagcgtgatagtcttgcacttcatcgataaagacttgtttaacttttgggaaaacgcgctgcgttaaataactgtaaacttgtgctgcaattacggcatccatagttgattggcgcgcaataatttgttcaaaggccaaccactgataatcgtacaattgctcagataaatcttggtaatcatagcggaccatttttaaagcgagcggtgctaatggttcgtcctcgcgaattaagcgtccgaaggtttgttgctgttcggtttccgttaagctttctaaacgcgttaaagtcgtgggggttttggcgattgttattaattgttcctgtagataacttgtgagttgttgttgggtggcttgaatgcgtttgtccaatggtgcatccaccggcgtcttcaagaaaaattgataactagtagcggcgtcaatcgtgaagggtaagccgctatttaatgactggaagtcgcttgcttgcaatgttagttggtcaatagctagggtaaccggttgtgctgcaatcggaagatctgccaactcttctggcagcaactgcgctaatagttgttgcaaagtgaggttgaccggtgtttgttcaccaagatctggtaaaacttgggcaatgtaatcctgaaaaagacggttaggtgaaatcatcaacacttcgttgagcgctagttccttacgttgccgatagaggatataggcaattcgttgaaaaataacggacgttttaccactgccggcaatgccatcgattaggaggtggtcagtcgtttgttggcgaataatcgcattttgttctttttgaattgtcgcggtaatggcactcatttgggttgttttagcttcttttagcgttgctaataatagtgggtcttcaatcgcgatttgggtatcgaagaaatcaattaattggtcagcttgaatttgaaattggcgccgttgatttaaagttaccgggatttggcggccgttagcttggtaactcgtggggccgaatgtctgttgataataaacatcagcgattggtgaacgccaatcaaaaataacaggttcgccatcttgattgatataactagctgaaccgagatagaagtcctcattgtcaatttcttccgggaaggttagtgtgattttggcaaagtagggttgttctaaaaggcgtaacgtttcgtcttttctagcaatcaatgaatcggttttgaggttgagcatatcgatttctttattgatagtttctagggcggcaaaggtgtcgaggttatcggcatatgaatcaaagttgagtttagcttcgccggtgatctgggccttaatggtgttaccggcctgatgattctgtgattgggcatcgttgatgaccgctaaagtggccgttagttgttgataaattgtggttaagtgggtttgttcttgttcgaaatcggttgtcatctattccaagtagtccttctttaattgtgctatttcttctggtttgagggccattgcttgggctaagtagttgtccatattgccgtaatggtgttcaatcgtttctctgacgagttcgagatgggcttttgaaacgcttttgccattcattgcggcgacttgggcgtcattgctgctgatgcgagtgggcgcggttgttgttaaacctaggacttcgtttgaaaggacgaaatcatccgcaatggttgcccagtctacgcctaatgcgctaaggatgagcattgtaccaatcccagttcgatctttgccagctgagcagtgataaaggaccgcaccgtcattgccgtggttattcaataatacggtaaagaggtcgcggtaagccgcttgtgcgtgagagtctgtgactaattgttcgtacattctgtccatgcttgaacgttcgggtgtagcaggttcttttttactaaagagatgaaataatccctttttcgctggttttttaggggtgtctgcttgatcggtaaacggaaataccgaaagacgatgataagttaattggctgtcgtcaaatggatctggggcaaccttaatttcatgacgggaacggaagtcaacatcataagcaacaccgtaatttaggaggtcctcaatgtctgttgcggttagtgcgttaagactgcctgagcgcagtaatttatgccatttaacggtcttaccgtcaacggttggataaccacctagttcgcgaagattatagctacgtgttaaatttaaaacccgttgttgttcttgcatatgtctgcatgggaatcaaaatttacaaaaaaagggtttacgttcgatgatgtcttattagtaccagcggaaagccacgtattaccaaatgaggttgatctaggagtgcaacttgctaagaatatcaagttgaacacaccaattatgagtgccagcatggataccgttacggaagcaccaatggcaatcgctatggcgcgtcaaggtggtttaggggttattcataagaatatgagtatcgaacgccaagcagatgaagtattgaaggttaaacgttcagaaaatggcgttattattgatccgttttatttaacagcggacaaacctgttagtgctgctgaagatttgatgcgcacataccgcattagtggtgtcccaatcgtttcaaatcttgatgagcttaagttagtcgggattattacgaaccgtgatttacgcttcatctctgacttctctgctgaaatcggaacggttatgactcacgaagcacttgtaacagcacctgtgggcacttctttagaagaagctgaacaaatcctccaacaaaacagaattgaaaaattacctttagttggtgacgacggtcgcttagccggcttaatcacgattaaagatattgaaaaagtgcaagaattccctaaggctgctaaggatcaatatggtcgcttattagttgctgctgctgtcggtgtcacaagtgatacttttgaccgtgcagaagccctattaaaagctggtgctgatgccattatcattgatacagcgcatggtcattcagctggtgttttacgtaaaattgccgaaatccgggctcgcttcccagaagcaaccttgattgctgggaacgtcgcaacagctgaaggcacaaaagccttatatgatgctggtgtcgatgtggttaaagttgggattggccctggttcaatctgtacaactcggattgttgccggcgttggtgttccacaattaacagctatctatgatgctgctagtgttgcccgtgaatatggtaagacaattatcgctgatggtggcattaagtattcaggtgatatcgttaaagctcttgcagccggtggtaatgccgttatgcttggtagcatgttagccggtactgacgaagcacctggcgaatttgaaatctatcaaggtcgtcgtttcaagacttatcgtgggatgggtagtttggctgccatgtcacacggttcatcagatcgttacttccaaagtggtgtgaatgaagcaaacaagttagtcccagaaggtatcgaaggtcgcgtagctgctaaaggtgcacttggcgatgttatctaccaattacttggtggtttacgttcagggatgggctatgttggcgctgctaacctccgtgatttacaggacaatgcacaatttgttcaaatttcaaacgctggtttaacagaatcacatccacatgatgttcaaattacaaaagaagcacctaattattcagcaagataaatgaaaattctaattgttgatgatgataaagaaattgttgaactactcagtatttatgtgaaaaatgaaggctatgaacccattcaagcttttaccggcaaggaagctttgactaaaattgccactaacccgggcattgacctaatgattttagatatcatgatgcctaatatgagcgggattgaagttatcaaagcggtccgtaaggattcacaagtgccgattttggtggtttctgccaaaacaacggatatggataaaatccaaggccttatcacaggtgcggatgattatgtgtctaaaccattcaatccgcttgaagtgatggcacgggtgaaatcattattgcggcgtagccaacaacaagtgacaaacgaagtgcctgacattctagaagtggggccacttgtgattaagcgtgattcacatgaagtgacaacgattgcgggcaaacaaattcaattaacggcgcttgaattcggaattttatatctcttagcgagccacccaaaccgggtcttttcagcggatgatatttttgaacgggtttggaagcaagaaagtatcgtgtcagctaaaaccgtgatggtccatgtcagtcatttacgggataaaatcgaagaagcaaccgacggtgagaaagtgattgaaaccgtctggggtgttggatataaggtcgaggtctaaatgaacgaatatcaagtcgggcaagattttaaaaaagtacaactcactgccaaagaaaagagtgagttgtttgctgaggggatcattacggtgatccttttattgttgttaaatttatcaattatggtcctattgcaacaagcaatcgttaataatccgcaattgcgcggtggcgtttggatgattaaaaatgcgattgcgattggccctaatggttggcacatctggagttggcaaaactggtttgtgattttgatggggattgcggatgtgctagtggtttattggcgcttaattcgccgctatcaccaaatgcagatgtggcacgttattggtgaattacattacatcgctgatggtcacttagaacaccgcatcaatttgcgggttaatcgcgatttgcaacgcgtgattgacagtgtcaatacactggttgatagcaccgttcgctcaatggaagaagaacgcaaaattgaaaagagtaaggatgaactgatcaccaacgtcagtcatgatttacgaacaccattgacgtccatcattggttacctaggtttaattgaagataatcagtatcaaaccaaggatgaattaaccaagtacacacacacggcttatgtgaaggcccaacaaatgaaagtcttagttgaagacttattcgaatacacaaaagtccggcaaacctcaacgccgattgctaaaacgacttttgatatggaacaaatgctagaacaactagcggctagctttgaattagaagcacagaagaaaaatatgcagattatggtagaatgccaacccgcaccattgatgatggaagctgacaccgaaaagttgggcagagttttcaataatttgattgccaatgcattgaagtatggcaaaggtggcaagcaaatcattttatcagccgaaaaggttggtcaagaagcgattatcaaagtctccaatgatgggcaacaaattccaagtgactcattaaatcaattattcgatcgtttttatcgcgtggaagcatcacgttcacaagaaaccggtgggacggggctcggtttagcgatcacgcaaagtattgtcgccttacacggcggttatatttatgcagattccaccccagaactgactagttttgtgatacacttacctttaaaactaggacgtcagattgaacctcaaaatggcgccgctaaaaacagttaagtgtttaaaagaatattacaggttttaatgactggccttttattagtgacaccggtggctattgcgacaagtgcaacgcaacagggtgttcaagcggctacggccactagcgcaccgcaagttgacgctagcgccgcaattgcaatcgatccccaatcaggacaggtcttgtatgaaaagaatgctgaccaagtcttaccgattgcatcgatgaccaagatgattaccgcctatattgtcttagatcaaattaaacagggtaagttgaagtgggatcaaaccactaaaccagacgctgccatttataagctgagccaggacaaggagttaacaaacgtcccacttcaagctgataaggcgtatagcgttcgtgaattatatcaagcgatgttgattgcttcagcaaatgatgcagcaatgatgctagccaatttagtggctggttcacaaaagaacttcgttgatttgatgcgccaacaagtcagtcaatggggcattaaggatgctaagttatattccgtttcagggttgaataaccagtatttaacaggagagacgtatccaggtagtgccgctgatgcggaaaacgaaatgagtgcttcagaagtcgcaatcgtggcccaacacttattgaagactttcccagaagtgttagaaacaactaaacaaacggcctttacgtttggtcctaagacaatcgacgaaacgaagatggccacttggaacttaatgttaccaggccaaaataatgcgcccaaagattacgttgtcgacggtttgaagaccgggacaactgataaagctggcgattgttttaccgggacggccactaaagatggccaacggattttaaccgttgtaatgcacgctaacggtagtgacaaagggcgccgttttattgaaaccaataaagtgatgcaatatgtttttgataactggcaacaaacgcaacttgttaaaaaaggggcgaccatcaaaccttttgcaacggctgatgtgaagtatggtcggacgaagacagtcgcgcttgaaacaccgcaagcaattgcaatgtgggttcctaaaggcacacaagttgctaatattgattgggagtatcaagtggttcaaggtggtcaaaagcgccaactaacggctcctgttaagaaggcagccgtcatcggtaaagtgacaccgaagattgcgggcgtgacaaaccgttacttagggacgacaccgcaatatacagtacaaaccaagacggctgatccaaaagctaatgtctttgtcttaatcggtacgggtgttcgtgaatttttcactaatttattttaaatggctttaacattggatgcatgtacattaattttaaaagagcatcatttactaaaaagtgtagccctcaacggggattcaaacttgaatatgacagggattgcctatgattcacgtaaggtgacagcagataccctctttttctgtaaagggaatttccgccccgtattcttaacgaacgctaaagaagccggcgcggttacttacgttgcagaacaacccattgttgaaggtaacgggatgaacgcgttaatcgtgacgaatgtgcaaaaggcgatggctgtcttgtcagctgccttttacgattatccacaagacgacctcttcatcgtggcgtacacggggactaaagggaagacgactgcttcttacttcacacaatcaatcttacaagatgccactaacaaaaaaacagcactcttttcaacaattgatcgggtactgggacctaaacctgaggaccgttttaagtcagacttaacgacgcccgaaagtttggacttgttccacgatatgcgccaggctgttgaaaacggcatgacgcacttggtaatggaagtgtcatcacaagcctataagaaaaatcgggtttacggtttaacatttgatgtcggtttcttcttgaacatttcacccgatcatgttggtcctaatgaacatcctaactttgaagattacttacactgtaaattgcaattactcgttaattcacggcactgtgtgattaacgcgcaaacacaaaacttcggtgatgtgtacgctgcagcgacaacgacaactgaaccagaaaatatctacttatttgcggacacgagttatcaaccagcacaaccagtggacattgatttccgctttgaaaatcaagccatgactttagctgaaagtcgctttaaagtaactgccgtttctaaaaaggcgattcaattaggcgtttctggagattatcaattacggctgattggcgattttaacgaaagtaatgcgacggcggccattattggtgcagccttaggcggtgctgatttaatcgctgcccaacaaggcattcgtcgtttgcagattccaggccggatggaaaccctagcggttgaaggtcatggtcaagtttacgtggattatgcccacaattacgctagtatgaaggcactattgagcttccttcaaaaggaatacaatcaacctaagttactagtggttgttgggagtcctggcgataagggggtttcaagacgggcaggctttgcgcaagtcttaaacgaatatgcagatcgtgcgattttaacgaccgatgatccgggttatgaagatccagctgccattgcggcagaaattttagccggtatcgatcaagataaggttgacacgacggttgaaatcgatcgtgcaacagcgattaaacaagctatcgaagaaagccaaccaggggacattgttgtattggccgctaaaggggcggatgcctatcagaaggtgcgtggtgtcgatacgccgtatccaactgatatggtgattgccaaacaagtggcacaacaattaagttaaatgaaaaaatcagttgtaatgagtacggtgttagtttcaggattgttattattgagtgcttgcggtcaaaagcaagaagcaaagagctcatcttcatctgaatcaaaagtgacaagtgttaaaaagacaagtcattcaaagaaagcacaaagtcaatcatcagaagaatctgtttcagaatcaacaagtgattctgaagtgacgagccaaagtagtcaaacaccaagtgcaactgattcgacatcaacagtcagtcaatccgcttcaacacaaagtagtcaagcgacaactagtcaaagtagtcaaacgagtcaatcgcaggccactcagagtcaaagtgcgcaacaatcaagcgcacagtcatcagctaatagccaatcatcagcaacgactaaccaaccacaaacaagtcaaccaacaacgactgtggatggcaatcaagcgattcgcttagtcatgcaacaggttggtcaagcacaagcgcatttatcttacttaaataacggcttgatcacacgtaatgcacaacaaggctacttaattaattgctacgcccctaacgaagattcaccacgggcaggctattttgtaacgcaagatggtcaggttgaacaaatttggtaaatgaataaaaaacgattgggcatagtcgctcttttattaatggtcgcaatggtggttgccggttgtggtcagactaaacagactaccaagggtattcaggtggtctcgtcactagatttctacggtgaagctgcgcaagcggtcttaggcaagcacgggcaagtaacatcaattattaacagccctagtttagatccccattcatacgaaccaacaactcaagatgctaagaaggttgcccaagccgatgttgtgattgaaaacggtttgggttacgaccagtggttatccaaggtggcagccagttcggattcagatcagcaaacaatgatcacagttaataaactaatgaaacgaacagatggcgccaatgaacatttatggtatgatttagagaccatgccaacactcactaaacaattaatcacgcgttttagtaagattgatccagcgcataaagctgattttcaaaagaacggtcaagcttacttgaagaaattagcgggtttgaaaacacaattggcagggctcaaggcgcaagctaagggccaaaaagtggcggtcagtgaaccggtcttcgattatgcgttgaaagaaatgggttatcaagttgctaaccaacattttgctaaagccattgaagacggtacggatccatcaccacaagatatcgacgctatgcgtcaactcattaaaaaacatcaaattgcctttttagttgttaacaagcaagaagaaagtcggacgattaaagagatgcaccaattagcaacgaaggaaaaagtcccagttgttcaggtgacagaaacactaccagctaaacaaacctatttaacttggatgcagcagcaatttgatgcagtaggaaaggctcaaaacgtaaaatgaatgacagaattagtaagtgccaaaaatttagggatgaccttcagtaatcgtcaggttctaaaggatcttaattttaaaattgaacatggtagcatgacgagtttgattggtcctaacggtgttggtaaaacaaccctcgtgcgaatcttaatcggcagtttgcaatcaaccgctggtgagttgacctttttaccggataagcaaagtttaaatattggctatgtgccgcaatttcggaatttagaagcggaatatccgctctctattcggagctttgtcagtcttaaccaattaaccaagcatctgccttggcatacgaagtcagagcgccaagcgttagataatattttggcccagacgcatttgacggcccttcaaaaaacaacggtcggcaatgcttctggtggcgaaaagcaaaaagcgtacctcgcgcaagctttaatcagtgaaccggatctcttgattttagatgaatcaacggccagtttggatattgagactaaagaagaagtgatggcactagtggcagagctaaatcgtctgcacggcttaaccgtgatttttgtcactcatgatttggatttagcgcgtaagtatacggatcaatatttattcttgaagcgcggtcaatacgaaatggggccaatgagtcaattagaccctaacttagaattagattaagtgttaacttttgattttatgcggcatgcgtttgtcgccagtacgtttattgcaattacatgtggtttaatcggggtcttcgttgtcgctagaaatatgtcgtttttagcgcatacgcttgccgagattggctttgccggtgcttcatttggtgtcttcttaggcatcgcaccgctaaacgggatgttattgtttacgatgattagttcgattacaattggccagatgagtgccaaggaatcaagacgggaagcatcgattagtgcgatttcaagtttgtttgtcggtctaggcattttattcttgtcgttatctaaccgcaatgcgagttacgcaacaaatatcttatttggttcaattatcgggatcagtttaacggatgtttatcagttaattacgttatcagcagttattgtagtcggcatcttacttttctaccggtacttggtctttgattcatatgattcaattggcgcccaagcacaaggcttgaagaccaattggttatcgatttatttcttaattctcttggcaattagtgttagtattgcggcccaaattgtgggttcattactagtctttatcttagtgactttaccagcgttcattgcgaaatatctcgctaagagtgtgccggcaatgttggcagtttctgttggagctgctttgttaggcgtttggttaggtttatggctagggtatattaccaactggccagtaactttcttcatcgcaacgctagaatttatcttttactttattgcacttttatatcatcaacatgttagtcattaattacatatcagcaagtaatgcttctaattgatcgaggcgttgttcaaaaacatcaaaggcgcgttcaagataatcggcgttcgtcatatccacaccggctttttgcatcgtttcaattgggtaactggcactcccgtttttgaggtaggtcagatagttgtcgagtgcacccggttggttcgtactgatttgatcagcgagggttgtcgcagcggcaaaaccagttgcatattgataaacgtaatagttcatgtaaaaatggggaatccgagcccattctaaggcaatttgaggatccttggcaacggcatcaccatagtagcgggcgtttaagtcagcgtagtaagttgacatgaaatcagccgttagaggggttccgttggctgctgcatcgtgaatataatgttcgaattcggcaaattgtgtttggcggaagacggtccctttgaaaccatcaaggtagtagttcaacaagtaggcttgaactttgggatccttttgggtcttcaaaagatattcagtaaggagattttcattcgttgtggacgcaatttcagcgatgaagattggataatcgccataaacgtaaggttgattgtgacgtgttaaataactgtggacactgtggccggtttcgtggaccagtgtgtataagttgttaagatcgtcttgccaattcaagagaatgaacggattagtgtcatatgcgccgccagagtaagcgccactgcgcttgcctttgttttcaacgacatcaatttgtcgttgatcgaagatttggtccacaattggggtgtattcaggccctaagacggctaatgcttcgcgcgctgttgcttgcgcttgtggataagtgtagctcaaagcgggtttgcctaaaagtggtgtgtataagtcatacatatgcaattgcggtaatgctaattgcttttggcgtaatttaacataacgatgcaataatggcagatgttggttcacttggtcgactaaggttgtgtagactgattcgggaatggccttaggcgcgagggctgcttggcgcgcactgtcgtagtgatggacttgagcgaggtagttgtgccctttgatttcagtcgcaagggttgtcgcaaacgtatttttgaattgatcgtaagtactatagagcgcttcgaagacgtcttggcggacctggcgatcggttgattgtaacaattggctatagaggccgtttgataattgatgcgtttggccggtttcatcgacaacgtctgggaattgaatatctgagttatccaaaacactaaaggtttgactagcagcaccaaagatatcgccagcagcggcaattagggcttcttcttgacctgataagacatgctcgcggctatcagtgatagtctggataaaatgttgataacttttaagtgctggctcattggtctgccagtcagttaattggtcaacgggaatttcgaggatagcgggttctaaaaaggcggccgccgctgaaacgtcagctgctaaagcatcgacctgagcttgataaccttgataagtggtattagttgtatcctgatcgtttttcatgctagcgtaaacgtagaccgtttctaattgtctaaagagcgttagcacttgttcaatcgttattacgagttgatcagccgttttaaacggttggttatattgttcaagtgctggtagtgcttgtttcaatgccgcaacagctgcctcaaaatctgagtcatttttgaaaatggtactgagatcccaggttgagttttcagggacttcggatcgtgtgggtaatttgtgaattgccatatgcagaattctaacttttttggctcaagagaagataaatacaaaaaaggcaaacgccatcgaaaattaaaaatattcctattaatcatcgtgattctcgtcttttcaggtggcgcgtatgcgatgcgggtcagtagccaattgaagtctgcagctgataaaatcaataaatcggaagccacttctaaagcgattaaaaataaaaaggccttttcaatcttattactaggtgttgataccggtgctgaagggcgaattgacaaaggtaattcagatacaatgattgttgcaaccgtcaatcctaaaaaagaacaagttaagttagtcagcattccgcgggatactttagcggaattacaaggcacgaagtcttttgatatgcaaaaaattaacgcagcctataatgttggcggctctaaaatggctaaaaaaactgttgagaagatgtttgatgtccctatcgactattacgtaacgattaacatgggggccttatcgaaaatcgttgatgctgttggtggtgttgatgttaacgtcccattctcgttcaaatataatacgacctttaaaaagggtaagatgcatctaaccgggaaagaagcgttagattattcacggatgcgctatgatgataaagatggggactatggccgtcaaaaacggcaacgccaagtcattacgtcgttgattaaatcagcagtttccttcaagtccctcaccaattatgaatcaatcttgaagacgctagaagatagcgtcgcaacggatctaagttttgatgacatggtggccattcaatctgattaccggacagcggcgaaatcaattacttctgattacctcaaggggcgtaatgcaacaatcgatggctcatcataccaagtgccaacaaccagtgaaattcaacgcgtgtcagatgttttacggacgtcacttgggttagagaaaacgaatattgataatgcggaaacaaaacaaaatgcattaaacacgaactttgcggcaacggaatatcaagatgaatttacgatttatccagaaagtgtcctaaaagatggcacaacaacaagtgaagcagccagcacgacaacgactgaagataataccactcaatattcccaaagtgcaccacagtcaaactggcaacagccccaacaggagcagtctcagtggcaaagtagttactaagtgtatttgcttgtaaatgtgatagggttattagtttttattggagtcggctttcttttttcaaagaaaaagaaggatatcgattggcgctcagttttaattatgttagtgattaaccttgtattagcttggttcttaacaagtttttcagttggtcgggacatcgttttaggtgctgccaacgggtttaattggctcgttcaagttgcttacacggggattgcattcgcattaccaagttgggtaaatgttaaacagatggatttcgtagccagtgtgttactccccatcctaatgattattccattatttgatatcttaacttatatcggtgtcttaccatggattatcaaatggttaggccgtgggttagctaaaatcacgggacaacctaagttcgaatcatttttcgcagttgaaatgatgtttttagggaatacagaagcattagctgtttcaagcttacaattgaaacaaatgaaggcagaacggacattgacgcttgcgatgatgtcaatgagttgtgtgacggcttcaattatcggggcttacacacaaatgatgccaggacaatttatcttaaccgctattccggtcaatattattaacgctattattgtgaccaacattttaaatccggttaaagtgacaccagaagaagacacaatcgccaaaatgggtggtagtggttcagcagttggcgaagaagaagctgctgacggtaagattgaacgcgaaccattcttctcattcttaggtgattcaattttaaatgccggtaaattagttttaatcatcacagctaacgtcatcgcctttgttgctttggcagcgttgattgataaagtattacaattatttaacccttggattacccttgaacatcttctaggaatcgtgatgttcccatttgcctggttgatgggcttagatgtcagccacgcctttgaatttgcacaatatatgggcacgaagttagtaacgaacgaattcgttgtcatgggtaaagttcaaaattcaatcacaacttttgcaccacattatcaagcagttttaaccgtttttgtcacatcatttgccaacttctcaacagtcggcatgatcatcggcgccttcaagggcttagttgatcgtgaaaagaatgatatgattgctaaaaacgtcggctacatgctcttatctgggattttagtctcattactctctgctgcaacggttggtttattcgtttggtagatggctgatttagtttatcaaacaattattgcagatttaaaaaaggcaattaatgcgggtgcttatcccagcatgaaattacccgacgaaagaacgttgacggaacattatcaggttagtcgtagttcggtgaagcgggcgttaaacgttatggctaatcaaggcatcatttttaagaaacgcggttcaggcacctttattaatcctttatatttaaagagtggttcattttttaattacagcggctctaatctaggggttaccgatagctttaaggctggcgatcgaaaaccgggaattaagttattagatttccaagtcatcaagcccagtgcagaattgcaacgggacttatttttggaaccagatgattttgtatacgaaatcaagcgactccggttgtttgatgacgaaccgttcatgattgaaaccgggtttatccccattaagattatgccgggactgaccgaaaaaattatttccggttcaatttttaattatttagaaacggaaaaaaatcaagaagtgacgcgcgccttcttatcaatttttgcagaaccttctacgcaagatgatcaagatcagctgcaactaaagccaactgaacccgtgggcatcatggaaggcatcttctttttggatgatggcacgccatttgaattttcaacaatgcgacttcattatcagtacatgaaatacaatacttttgtttcagtcagcggtcgggaatagatgacagattattcaagtaaagaataccttgctaaagttgatgcattttggcgagcagctaactatatctcagtaggccaattatatttaaaagacaatccattattacaacgtcccttagaagcaaaagacgttaaagttaaaccaatcggacactggggcacaatctcaggtcaaaacttcttatacgcacatttgaaccgtgccattaacaagtacgacttgaacatgttctacgttgaaggcccaggtcatggtggccaagtcatggtttcaaattcatacttagacggtagttatacagaaatctacccagaaatttctcaagatgttgatgggatgaagaaattattcaaacaattctcattcccaggcggcgttgcttctcatgctgctcctgaaacacctggttcaatccacgaaggtggcgaacttggttattcattatcacacggtgtcggtgcaattttagacaacccagacgtcatcgcagctgttgttgttggtgatggggaagctgaaactggcccattggcagcatcatggttatcaagcacatttatcaatcctaaaaatgatggtgctgtcttaccaatcttgaacttaaatggtttcaagatttctaacccaacaatcctttcacgtaagagtgacgaagaattaacaaaatacttcgaaggtaacggttgggcaccaatctttgttgaaggcgacgatcctgaaaaaatgcacccagcaactgctgctgcaatggatgaagccatcgaaaagatccaagcgattcaaaaagctgctcgcgaaaacggcgatacatcacgtccagtatggccaatgatcgtcttccgcgctcctaaaggctggactggtcctaagacatgggatggcgtaccaatcgaaaattcattccgtgcacatcaaattccagtgccaattgatagcactgacatgcaacatgccgatgcattagttgattggatgaagtcatatcgtccagaagaattatttacagctgaaggtcaattaaaacctgaaatcgctgcaatggcacctaagggcgacaaacgaatggctgctaacccaattacaaatggtgggattgatcctaaaccacttcgcttgccagattaccgtgactacgctgtggataacacagaacatggtaaagttgttgcgcaagacatgattgttttaggtgaatatgtccgcgatattattaaagacaatgatcaaaacaaaaacttcagaatctttggccctgacgaaacaatgtcaaaccgtttgaaccacatctttgatgtgacaaaccgtcaatggatggaaccaatcaaagaaccaaatgatcaattcatggcaacagaaggccgtgtccttgattcacaattatcagaacatcaagctgaaggctggttagaaggctatgtcttaacaggtcgtcacggcttcttcgcaagttacgaatcattcttgcgcgttgtggattcaatgttaacacaacacttcaagtggttaagaaaagcagacgaacaagcatggcgtaacaagtatccttcattgaacgtgattgcaacctcaactgttttccaacaagatcacaatggttacactcaccaagatccaggtgtcttaacgcacttagctgaaaagaaacctgaattcatccgtgaatacttaccagctgatgccaacacattattggcaacaatgaatactgtcttccaaagccaagaaaagattaacttagtgattgcttcaaaacacccacgtcaacaatggttctcaattgatgaagcaactgtcttagttaaaaacggcttgaagattattgattgggcaagtacagatcaagatgctgaaccagacgttgtgattgcagctgctgggacagaaccaacacttgaaagtttggctgctatctcaatcttgcacaaacaataccctgacatgaagattcgtttcattaacgttgttgatctattgaaacttcgttcacctaaagtggatcctcgtggcttaacagatgaagaattcgatatgtactttacaaaagacaaaccagttgtcttcgctttccatggtttcgaaggcttagtgcgtgacatcttcttcgatcgtcacaaccataacctccatgttcatggctatcgtgaaaatggtgatattacaacaccattcgacatgcgtgtcttgaatcaaatggatcgttacaacttatctaaagaagtcgcaattgacgtgcttggtgaccaagctggccaattcgcacaatcaatggatgatatggttgctaaacacaaccaatacattcgtgatgaaggtactgatttacctgaagttgaagaatggcaatggacaccactccgttaaatggcaaagaacaaaatccgtgtacgatatgcaccaagtccaactgggcatttgcacattgggaatgctagaaccgcattatttaattacttatttgcacgtcacaataagggaactttcgttatccggatcgaagatacagatacgaaaagaaacattgcagacggtgaaaacagtcagttagataacttaaaatggttaggcatagattgggatgaaggtccagacaaacctggtaactatggtccttaccgccaatcagaacgtcgcgaaatctatacaccccttattcaagaattagttgaaaagggtcttgcttacgaatcatataaaacagaagatgaattaacggcagaacgtgaagcacaaaaagctgctggtgaagcacctcgttacgtttacgaatatgaaggtatgagcgatgatgaaattaaggccagccaagaagctgctagagcaaaatgcttgcaaccagttgttcgtcttcgtttacctaaggatcatgtttataagtttgatgacatcgttaaaggtgaaatcagctttgaatcagatcgtttaggtggcgactttgtcatcatgaaacgtgacggcatgccaacttataactttgccgttgtcgttgatgatcatttgatggaaatcacacacgttttacgtggggacgatcatatcgccaacacaccaaaacaattggccgtttacgaagcctttggctgggaaccaccaatttttggtcacatgacattaatcatcaatactgaaacaggtaagaaactaagtaaacgtgatgaatctgtgcttcaatttatcgaacaatatcgcgaattgggttacctaccagaagcgatgtttaactttattgctttattaggttggtcaccagttggcgaaagcgaattgtttaaccgtcaagaattcatcaaacaatttgatccaaaacgtttgagcaaatcgcctgctagtttcgatcaaaagaaactcgaatgggtaaataaccaatacgttaaacaatcagatcctaacaagatcatggatctttcattggacagcttgattaaagcgggtaaaatcgccgaaaatcctgatagcaagactatcgaatgggcgcgtcatttgatcgcgttataccaagatcaaatgagttacacagctcaaatcgttgaaatgtcagatgtcttcttcgaagaacctgaacaattagatgcagaagcgcttgaagaattaaataacgaaacagcaccggttgttttgaaggaattcagcgaacgcttgaaagatttgacattattcacagcaccacggattatgcaaattatcaaaggcatccaaaaagatacgaagatcaaaggtcgtctattgtacatgccaattcggattgcaacgacgcgcgaaatgcatggcccatcattaccagattcaatcgaattactaggtaaagatcgtgtcttagcacatcttgaaaaaacattagccgaaattaaataaatgaaagttttaacttttggtgaaatgttaatgcgtttgaagacgccggggaatcaacgtttattacaagcggatagtttcgaagcctcatatggtggtgcagaagcgaacgtcgctgtttcgttggcacttttaggggatcaggtcgcttatttaacgaagttgccggagaatctattagggcaaaagggtatgcaaactttgcggggatacggtgttgatacgactaagattcaatacggtgatggccgcttgggtttatatttctttgaaaaaggtgccagtgttcgttcaactaatgttgtttatgatcgggcacatagtagttttgcgacaatgaccgctagtgaattcgattgggcaacgatttttgaagatattgattatttctatttctcagggattacacccgccatttcggctgaattggcgcaagcagccgagacagcttgccaatattgtcaagctcacgatattccagtagtttgtgatttaaactaccgcgggaagttatggtcaccagaacaggcgcaagcaacgattaaacgcttaatgccgtatgtcacgatctgtattgctcatgatgaagactttgaagcaacactcggaattcaagcctttgatggggatgagagtcacggtatcgcgcaaaaagaatcttttaaagcagcgatgcaacaagtccggcagattttccctaactgccaaatggttgccagcatcttacggaatattcggtccgttgaagatagcgagtggctagcattgttattaaaggatgaccaattctttgaaacgggcacttatcaaatgcacgttatggaaggggtcgctgccggagatgcctttggcgcgggcttaatgcacgggttattaaataactttacgcctgatgagatgttgcaattcggcttagcagctagtgtggccaaattgacgattgctggcgactttaatttaattggtgaagcagaaattgaagcaatcgcacaaagtggcggcggtgcccgcttatcacgataaatgacaaaaaaagtagcgtttattacaggtgcagcacaaggaattggtaaagccatcgcgcaccgtctttcaaatgacggttttgcagttgccatcgctgatttcaatttagaaggtgcccaagcagttgcagctgaaattaacgaaacgggccgggctatcgcagttaaggttgacgtttctgatcgtgatcaagtatttgcagcagttgaaacaacggttgctgaactgggtgggttagatgttgttgtgaataacgcaggtgtcggcccaacaaccccaatcgaaaccattacaccaaaacaatttgaaaaagtatatgcgattaatgttggtagtgtttactggggcattcaagcagccgttaaagccttcagagaccttggtcatggtggcaaaatcatcaatgcttcatcacaagctgggcaagtcggtaatccagaacttgctttatatggtggcactaaatttgcgattcgggggattacacaaactgcagcccgtgatttagctgatcaagggattacggttaatgcttattgtccagggatcgttaaaacaccaatgatgatggatatcgcacataaagttggtcaaaatgcgggcaaagatgatgaatggggcatgcaacaatttgccaaagacatcactttaggtcgcttatcagaaccagaagatgtggcagcctgtgttgcttatttggctggaccagattctaattatatgactggtcaagctttaattatcgatggcggcatggttttcaattaattagagttgaatgatttttaaaagtgcagccgatacttcttcacgcttatcttcagggagttgcgttaggtaatgcaccaactttaaggtttgagcacctgatagtgctggatcgccaaaaaagtcaattagctcaatccccaatgcttcggcaatatcgttgagtttcttaatttttaagttatcaacttcaccgcgttcaatccgagaaataaagctgtaagaactgccagatttctcggccagttcttcaatggttagccctagctgcttacggtgttcgcgaatcatctgactaattgtatctagcatatgatgaaaaagagttacagtcttatcttaacggttgcggtggttagcttattgggcgcttgttcagctaaaggtgaacaaacaaccaaatcaactagtactagtaccagccattctaaaaaagtgacatcagtaaccagcagtcaaaagcaagtccgtaaagaaacgacttcgagtgtgtcgcggacaaaacagcaagcacaatcacagtcgcagaccaaacaagcaaaggcgttgtgggatagtagcaagaaacaagccttggcaacctttatgagtggttggggaacgacgatgggccaaacgtatcaatcttacgatttaacacgggatactgattatgctggtattcattttcctagtaagttagcccagaccgatttagcggtcgacgatacgccagtgacggcggcttggagtactgatggtaccggtagtgcggactataacgttgttgcaatctattgcgatgtcgatggcgggacagttgggggtcacttatacttatttacgttccataatgggcaaccagtggtcttgataaggggacaccagataaccggctccatttcagcgtcactgctaatacggatttgattgaagacgggctttgccaatattgttagtgggcaaggcagtggacaggcaaatacgagtcaaccgacgactagtgcggtgagtcctatttcggcagccgaagcacaagcgatagtggccgcgcaaaacatccaatacagagaagaacaaggagaacctgcggggaataaaacaagcttagcaggtggcggtattgttctaaagcaatacgctggcgcacaaggtatcgatattattaagctaactcctaaaccggggaacaaggttaacatcaccgttcaaaatggttctcttagagatggccaagccggtgagacggcacccatttcccaaaatatcacggttgatcgctaattattgtcgggttcgatcgatttcggctctgatttccttaaagctttgttctgtttcttgaccattattgacggccaccatcatgaagaggctatcgataagactgatttgggcgattaaagcatgcagcgcttcggcccgataattagtttcttctgaaattgaaagtaaggtgatatcgccgagcttggtaagacttgaattaccgaaactggtgatgacaatcagtgggacttggcgctcttttagaatgcgggcgagttctaaagcgtccttattttgaccactgtgtgaaatgataatcgcgcaatcttgattagttagttttgtcgcttgcatgagttgtagatgataatcttggttgaagactgtggggatgctggttctgaggaatttgtggtaaccatcttgggccacaatcccggaagcccccaaaccaaataaactaagcagatgggcgcggttgattaaggcgaccgctttttgaagttgttcttcagttaatagcgaccaagtagcttttagcgcgttgctgttagaactgaagattttttcggccatcgttgtaaaagtatcgtttgcattgatttcatgaaaaagtggtgaggtgttggcttctttggccaggagtgccatcttgaaggcttgaaaattatcgaagcccaatattttagcgaaacgtgaaattgtcgcggtggagaccccacagttggcggcaaattcttgaatcgttaaacgctgattgaattgtgattcttggaagatgtagtcagcgatttgcttatatttttcgctaaaattatcataataagatcgtaataatgaatcgattgcttgcgccatatgaaattagcaatggtcggtttaggcaaaatgggtatcaacttagtagccaacttacgacggaacggtcacgaagttgtggcttttgatttaaatcaagcagcggttgaagaagccgttaacttaggtgccacagcggcaacggatttagacgatgttttagcacaattaacgagtcctcgaattgtgtgggtcatgttaccagctggtaaaccaacagatgccacgattcaaacattaagcgaaaaaatgaatgccggagatatggtgattgacggtggtaattcattctttgaagattcagaacgccataatgcacttttaaaagaacaagggattcatttcttcgacgctggtacttcaggcgggatgagtggtgccaacgctaatgggaactttatgatcggtggcgatagccctgaagccttcaagacaatcgaacccatctttaaatcaatcgcccaagaagatggctacctgtacacaggtaaagctgggagtggtcattacttgaagatggtccataatgggattgaatacgggatgatgcaatcaatcgcagaaggttttgatgtcttagaacatggccgtttcgaatatgacaacgaagcagttgccaaggtttggagcaacggttcagtcattcgcggttggctaatggaattagcacaatcagccttttctaaagatccagaattagaatccttaaaaggtgttatgcattcttcaggtgaaggtcaatggacattggatgaagccttgaaattacaagtaccaacgccagtaattgggttatcattgatgatgcgttatcgctcacttgaagatgatacctttacaggcaaagttgttgccgctttaagaaacgaatttggtggccacgctgtcgataagaaataaatgaaatatatgattggtgccgatattggaacaacaagtacgaaagctgtcctatatgatctaaaagggaatgtgaaggcctatgctaacgttggctatccactataccaaaatgtacctgatatggcggaagaagatccagatgaaatcttcgaagctgttgtggaagtactgggaaaagtaatgcgcaaaggacatgtacaagctggcgaattacaaggtgttagtttctcagctgcaatgcatagtttaattttgatggatcgtaaccatcaaccgttgacacgggcgattacttgggcggataaccgcgctgctaaatatagtaacgaattaaaggccaatggattagggcacgagatttatcaacataccggaacgcctatccacccgatggcaccattatcaaaaatcatttggttgcgtcatgaacaaccagacctcttcaaacaagcagcacaattcattgatattaaaacatatgttttccaaaaattattccatacttacaagatggaatattcaatcgcttcagcaactggcttgttcaatatcttcaatttagattgggatcaacaagctcttgaagtagccgggattacccgcgaccaattaccagaattagttgaaccaactgcacaaattacaggtttagatacaacttacagtcaagaaacgggtatcagtagtgatgtcccatttatctttggtgcgagtgatggcgttctatctaacttaggggttaatgcaatcgatcctggcgttttggcagtgacaattgggaccagtggtgcagttcgagtggtggttgataaaccagtcgttgatccaaatggtcgattattctgttacgctttaaccaaggacaagtgggttgtcggtggacctgttaacaacggtggaatcgtcttccgttgggttcgtgaccaactctttgcacctgaaaaattaacggctgaacagatgcaagtatcaacctatgatcttttgacgcaaattgctgaaaagattccagccggttcagacgggttgttattccacccatacttgggcggcgaacgagcaccaatttgggattctgatgcacgtggttcattctttggcttaacacgtcaacatacacgggcccacatggtacgtgcagcactagaagggattgtttacaatctctacatggtgatgttaatgatcgaaggcgttgctggtaaacctaagagtattcaagcaaccggtggttttgcccgttcagaattatggcgtcaaatgttagctgatatcttcgaacaagatgtgacgattccagaaagttttgaaagttcatgtttaggcgccgcagttttagggatgtattcattaggtttagtggatgatctctcagctgttaaagacatgattggtgtgacaaatgttcacgaaccaaaagcagaaaacttcgacgtttaccgcgaactaattccaatttggattcgcctcactcgggaattgagtccagaatacagtgcaattgctgatttccaacgcagacatatgcaagttaaagaagcaactaaggattaaatggaactcttagtcttatttttaggcatcatgttattattactactcattattaagttcaaactgaacacgtttgtttcgttagtgttaacagcaatggtcgtgggtgtcggtttagggatgccgctgactaaaattgcaactagcgttcaaaatgggattggcggacaattaggcgaattatcaatcgtctttgggtttggtgccatgatgggccggctcgttgctgatgctggtggggcgtttagaatcgcccacacattgattgataaatttggtaagaaacgactccaaatcgcgattatgttggcgtcatttattatcgggattgccttattcttcgaagttgggatggtcctattagtcccaatcgtctttgcgattgccgttgaagcgagcgtaccgattttatacttggggattccaatggctgccgctttatctgtgactcatggtttcttaccaccacatccagcaccaacagccattacatctgctttaggagctaatgcgggacacgttttattgtacggtgtcatcattgcgattccatctgtgattattgcagggccactctttaccaaagtggcacgtaaaatgattccagacgcctttgcacgccaaggaaacttgacggcacttggtcctcagaaaacttttaaattagaagagacgccaagtttcggtattagtgttgtgacttcattattcccagtaattttaatggcgatcacaacggtttaccaaatgttattcaacggtggttcgctaccaaagaatccaacgttattagattcaatcattggttttatcgggacaccagcgattgcgatgaccatttcattgttattagcaatgtacacaatgggctggggtcgtcgtattaagacaccagcaatcatgaaaacaattgaagaagcggtcaaatcaatcgccatgttactcttagtaattggtgggggcggggccttcaaacaaatcttaatcgatggcggtgttggcgatagcgtgacaacattattcgcgcatgcgagcttatcaccacttgtcttaggttggttaatcgccgttgtcttgcggattgcgcttggttcagcaaccgttgcgtcattgacagcagctggtttagtcttaccattgatgcaatcagcaggcgtgaaccctgctttgatggtgctttcaatcggtgctggtagtttagcagcatcacacgttaacgatgctggtttctggatgtttaaggaatacttcgacttaagcgttaaggaaacattggcaacttggaccgtcctagaaacattaatttcaattgtcggtttagttggcgtattactattgagtttagttgtctaaatgattgaaaagagagtactctcggcaaccgatgaaccagcattttatgacctcacccaatacgcctttaataaaccggatagtgagcaacggcggttattcttccaaaaactgtatcagaacagtgtcggttttggtgtttttgatcagggtcatttgaagagtagtttattagcgacgccgtttgatgttaatttcaaagggcaaacatttaagatgagtggcattggttatgttgccagttacccagaattttcgggccaaggtggcatctctgatttaatgcacttagcctttgaacggatgcaagcagatggggttacactatcttatttagcacctttttcgtatcctttttatcgtcgttttggttatgaacaagctttcgagcaaacctgttatcagattaaaacggcgaacttgccacgtcttaaatttgcgccagatcaggggtacgttgaacggttatcgttaagcgcagccgtgccgttgatcagtgccttccaacagcaacatccgcataaccaggtcggcggtatccaacgggccgcgtggtggtggcagtataattgtttgaagcatactgattgggaagtagccgtttatactgacggcgaccaacaagtagcaggctatgtgatttatagccgtcaggcgacaactctagagattcaagagttattgacatcaacggttgccagtcaggaacaacttgttaagtttattttcaaacaccaatcggcctatcaaaccattcgctatgagagtggtttaacaactaacttgggtgatttattaccggatccgacaattgttgaaacaacaacggtaccttatatgatggcgcggattgtgtcgttggctgatttcttagcacgttatccgtatgaagtagcggaccttgaggcagtgaagattgctgttagtgatgactttttacccgagaatagtggtgtttggcaattgagtttacacgcgggccaaccgacggtaacgaaattggcgagccaaacggcggatatcacagtaaccattcagcagctcaccaaggcaatgatgggttaccgcacactggcatcgcaagcgcattacggtcaggtcagtggtgatgcggtcaaaattgctcaattaagcgcggccttcaatcagacgcaaccgatgttgtgggactatttttaattagattaagaagtagccaaatgttcctaagatgattaagaacaagaagttcataccagtaaagacgactaagaatttaccaatatctttaccccagccttttttgaaacgtttgtaagcaattaagttagcaagtgaggcgaacattgtgccgaccccaccgatgttgatggctaagaacattgcgtgactgtggttggtgaagcttgatagtaaaatttcagttgggacattagcgattaattgacaactaatgaggcctgtaagataggtttgtttagcagtaccaacaagtgaacgcatgaaagtggcgattgttgggatgtggcttaagttaccaactgcgatgaagaagcagaagaaagttaacaataaaccataatcgactgttttgaaaagcttcggatcaaatactaaaatcgcaatgatgaccaagataggtgtgacccataatggaatcaatgagaagactgctaagaaaacaaccactgtgagggggacgaaataccataaaggccctttttcaacttcaactggatggagaccatggagtttgatgggttcctttggaaaaagaaacgttgtggcggtcaacataatgatactaacaattaagaccgggattgaatattcaaagaaatggcgaatcgtcatatggtagaacgatacgaggaaaatattgtgcgggctcccaaatggtgtgagggatgaaccgagattagccgaaatcgtgattaacgtgacaggtaaaatcggtgaaaaatcaagttgccgcgcaattaggatgaacaacggtacaaaagttaagaccgtcatatcattggttagaaacattgccccaacaaaggtcaatgccaagagcatctgcattaaagcacgtttggaatgactcttaataatcagttcccgtgcgaagtaatcgagcacatgtagtcgttgataaacttggacgagtgtcataatacaaaagacactgacgatcacgtgaaaattaacgtaactaagatgggggcgattgaaaaatgaggtgacaatagctgcaatcgttgcggcgagaagtaatttgtcatctaagaaaaaatctcggatgttcaaagcaatgtttttcatatgaaagatgccccaagacatacagtcatattaggaattgtcgctgcagtgatttcaatcatctgtggcatgttaattttgtacagtattttacacgttagtttgtggctttcaattttagcgagtgtcattattggactctatctaggctataacactttttatagtacctatttagccgaaatgattaaaattgaggttatcaatcaaggtttggacagcaaggatttagctgaattgatgcacgggaatgccaaggactatcctattattcgtggtgatttacgattgattattccacggcggaaacgtgcggaattattggctaagctacgcgatcgggtaggctgaatgagtattttaaaagtcgaaggactaagtcaacaatttttagacaaacaactttatgatgatgccgggttccaagtcaataaaggcgaacacatggggattactggccaaaatggggtcggtaaaagtaccttgattaatattttaacaggcgctattttaccagatgagggtaaagtaacctggcaaaagaacattaagattggttatttggatcaatatgccaaattagcgccaggcctatccatttttgaattcttaaaaacggcctttgcggatttgtatgctcaggaagaacgaatgagtcaatactacgccgactacgcaacgagtttagatgaccaactactcgaaaaagcgggggcaattcaagaacttcttgaagctaaaaacttctatgaaattgatacgcgggttatgcaagttgcgactggtttagggattgatgcgctagggatggaccatgacgtttcacaacttagtgggggtcagcggtcgaagattattttagcgaagttactattagaagaaccggatatgttgttattggatgaaccaaccaattatttggataccaatcatatcgattggctcagtgattatttgaataacttcgaaggggccttcattacaatctcccatgattatgatttcttggaacgggtaacaacctgtattgccgacatcgaatttgggaagattaccaaatataccggaacgctccaacaggctttccgccaaaaagccgataaccaagctagctatatgaaggcttatgagaatcaacaaaagaaaattgaaaagacaaaggcttatatccgtaagtataaagctggttcacggtcaacaattgccaagagtcgtgaaaagcaattagctcatatggatattttgacacccccaagtaatcgcgtgaaggctaacttccgtttcccataccacgcaacagccagtcagattctattgacgaccaatgatctagagattggttacgaaaatgcgttattgccagccttaaacttctcaattggtcgggatcaaaaagtggtgctcaaagggtttaatgggattggtaagtcgacattgattaaaaccatcattaaagaaattccagcaattagcggtgattttgaaattgctagcacggtgaagtttggttacttcaagcaggacttaaagtggcctaacaatatggcaaccccactccaatatttacagggcgaatatccagaacaaaagcaaaaggaacttcgccaagtattatcccggacaggactaactgctgaagaagcgatgaagccgttgaaacaactcagcggtggcgagcaatcaaaggttaaaattgccgaattgctcctaacctcaagtaacttccttctattagatgaaccaacgaaccatttagacgatgatacgaagaacgcattgcgcaaagccatccaagaatttgagggcggcgtcttgctagtgacccatgaagaggacttttaccaaggcgattggatcgataaagtgttagatgttgagtccttgattaaatcttgaatggataaaattgatgtaacaaaattaacccagatgtcgaactttgaagtcgcagcactcttttataaatatgcactgacaaacagtcgcggtttacgggcgattaatgtcgggcgcggcaatccgaattggattaatacacaagcaagatttgcctttaatcggattgttgaatttgggatgaaagaatccttacaaacaattaacttagacgatggcaatcttgctggctacaccgatcaaacaggtatcgcggaatgcttcaatcagttcttagatggtgataatccggtggatgcttttttgaagcaggctttggcttatacccgagacgtcatgcatatcaatcaagatgaacttgtctttgaatgggtcgatggcgttattggcaaccattatccagaaccatcacgcagcttagtgaatgttgaaaagattttaaatcggtatctagaagtaaatctctatcgcggtgaacatctatcagacaagacaaaggtctttccaactgaaggtgggacagctgcgatggtctatctttttaatgaactaaaggtcagccatattttagaggcgggtgatacgattgcgattaatacgccaatctttacaccgtacttgcagattccagaactaaatgaatttaaactacaagagtttaacgttagttctgatgaatctgatgactggcaattggtcgatcataaatttgaagagttgaaggatccaaatgttaaagcctttttcgtggtgaacccaaccaacccaacctctagagcttttagtgaccatgcgctagataagttgaaggaagttgttgaagccaatccgaacctcgtgattattacggatgatgtttatgggacgtttgtcgatgattttaaaaccatctattcagttgtgccacataatacattgttagtgtactcattctctaaattatacggggcaaccggtcaacggattggtttaatcgcaatgcacgacgataacattttcgataagttgattgaagaaatgacagcagaagatcctgttattagagaagctttccggaaacggtattcgtacgtcacaaataagccacatgaaatgagttttatcgatcgaacggtagcggatagtcgaaacatcgggttataccatgcagctggcttatcaacaccacaacagatcacaatggcgctttttagtttgacgaacctgatttacgaaggcagagaagatccgtatgtgacagcatctaaggaaattgtaagtcatcgatataaggccttttgggaatcgcttgggttagtcgttaagacaaccgaagaaaatgcggaatactacactgtttttagtatctataagttagcagagtcgaaatactctaaagatttcagagcttacttggaacaaaactgtaatcatttagcatttgaatggcgactcgcagcggaatatggggttgttgtaatggatggtgctgggatgggaaccaaggcggggtatttaagaatctcacttgctaaccgtccagataaggactatgaaacagtcggcggtcggatttctgacttactggcaagctactatactgaatacttgcaatctaaagcacaataaatgactcaaacaattacagctaacaatatagaggcctttgttgctgaaaaaccgttagttattttagacttttgggcggattggtgtatgccttgtaaaatcatgacaccaatgattcaagaattgcatgcagcttctaatgacgcatttaagctcgggatggtggatgttgaagatcaacctgaattagcagaacgatatgatattcaatccgtaccaaccttattaatttttaaaaaaggtaaggcagctgaaaaagtaactggtgctttccctaaagaaaaattaaaacggtatttagataagaagatagcagaatctaatcatgaaggctaattaaacaatacgacggacatagcgataaagtaataatgcgctaaattcgcagagtaagataagaacggctaatgggaggtaagtgtaactacccatgataccgacaagtggtgataagaaaataccaaagacatacatgcctaatcctaaaacggatgaagcgataccggcttgcttgccctgtcgttgaagtgctaatgaggtgacaacggcattgataagaccaagggttgaaacgactaggaataaaccaatcaatgccaaccaaagtttgttagggcctaagccactgattaaaatgcagaagccaccgatgagcccaccgataaggcctaactttagttgttctaattcggtgaaccagttaatcaaaacggttgataattctgccattaggataatcccaatgccattaatcccgtagatgagactaaaagttgacttcgaaagtgaaaagacgttttgtaacataaaactagagccagaaatataacagaacattgcaccgtagacgagcccttggataagtacgaaacagataaaaggacggtctttaaagactgtttgaacattgagtcgggtactggttgccttttgatcggctggggataacttgtgcgtttctttaaatccgaaaattaaaccgagtaataagagcaggccggtacaaccgatgaaaccgaagataccttgccaggaagtataccgtaatagtagactaccaattaatggtgaaataattgggaaaatcccgttaacggccatcaataatgcgataaacttagttagttgtttgccgttaaagagatccttggcaacggcccgggtgacaacttggccagcagaacttgcaagtccttggataaatctaagtaaaaagaataaccagatattatgtgtaacaagtgatagaaaacaagcgataatagccagtgatgtcccaatcaccaacggctttttgcgaccgacgcgatcactccaggcccccatgaaaatgggaccaattgccaaaccggctaaacacattgttaaactgatctgaatcatggaagcggaagtgtgaaaatcagactccataattggaaatgccggtaaatacatatcgactaataatggaccataagcgctcaaagagccgagtagaacggatagccagatgatccttgattttgaataatgcatatgaaaattgcacaaaaaaataaaattctagaaacctgcttaattgcggggcgcatcatgatcgaaagtggttctgaaatgtaccgagttgaagatacgatgaatcgaattgcttataatgccggtattcaaaagagtgtggtctttacgacaccgactggcttatttatcgggatcgaaaatcaaccttatgtgcaattggaatcagttgcagtgcgtacgattaacttagaaaaagttgaaaatgtcaatacagcttcgcgacagtttgcgacaaaggagattacgttagatcagttgagtacccgcttgaaacaaattgaccaacatacgccgtattttccattatggattcaaattattgcggcggcctttgtatcagcgctattaatgattattttttccggtgaatatgactgggctgatttattaccagcggctttagtgggggcattaggttatgccgttttctctgaaataaaccgtttgactagcattcggtttatcggcgagtttttaggggccgtttcaattggcgtgtcagcttacttattaacgaagtggcacctaggggtcgatcttgataacattattatcggggccgtgatgccacttgtgcctggtgtggcaattacgaattcaattcgagatatgttggccggacacttattatccggaatggtccgtggtgttgaggcgcttttaagtgcctttgcgattgggactgggattgcgttaatctttagatttttaatttaaatgccatattggctacagtttattgtccaagcgatctttagttatttttcaacggtcgcctttggaatctgtattaatttaccgcgccgagcattagtttggtgtgggattgctggcatgctcggctggcaagtttactgggtgttgttcaatcttggtagtggtcggatgatggctaatttatttggtgcgttagccgtcggcattgtcgggagtattttggcccgttacaaacgcatgcccgttattattttcaatatcccgggactggtaccattagtgcccggtggaacagcttatcgggcggttcggaatcttgttttagggaacatctcacaggctgtgacgcagagtatttcagtcattatggtggccggcgcaattgcagttggctttatgtttgcacaaattctagcggatattacaagaaaaagaagtagtgtgccaatttggctttcaagacactaaatgactattacatatgttgtgatcaatattatcattatgttgatcatgttatttgttctaaataagatggcgcggattcacgttaaattcagtcgacgggttttcacggcattaggtgtcggtattttgtttggtgctattttacaattaatttttaaaaccgactcacaagtagtgaaacaaacggctgattggattgggattgtcgggaatggttatgtatcattcttgaagatgatcgtgatgccgttagtcatggtttcaatcattcaagctattaccaacttggaatcttctaagggcttaggtaaaatggccggaatggttattggtttattagttttcacaacgttaattgctgcaactgtcggttcagtaacgtcaaacgtgtttgatttaaatgccagttcaattcaatcaggacaagttgaaaaggcacgttcaaaagaattagaaacaaaattaggggatgtccaagaacaaaccgtccctgaaaagattgtcagcttcattccagaaaatccatttatggatatgactggtgcacgaccaacgtcaacattaggggttgttattttctcagccttcttaggcttagcagccttacaattacgacggaagaaaccagaacaagcagagacgtttaataaaatcgtcaatgccttttacgccgttatcatgcgaatggtaaccttaatcttgagaatgacaccgtacggggttttagcattaatgacaacgacggtggcccaaacagatgtccaaggtatcttgaacttagggaagttcgtgatcgcctcgtacgtcgctttaatcatcatgtttatcgttcatttcctattgatcacctttacgggcttaaacccaattaattacattaaaaaggttattccaaccttaatctttgcctttacctcacggacaagtgcgggctcaattccaatgaatattgaaacccaaacaaaacgtttaggggtcgaagaaggcatcgccaacttatcagcttcatttggcgcttcaatcggtcaaaacggctgtgctggtgtttacccagccatgttagctgttatgattgcaccaacggttgggattaatccttggagcatcggcttcttggttaaattaatcttaatcgtggctatcagctcatttggggttgccggtgtcggtggtggcgcaacatttgccgctttaattgttctttcttcaatgaacttaccagttggattagccggtcttttaatctcaatcgaaccattaatcgatatgggtcggacagcattgaacgttaatggttcaatgactgttggggtgttgacggcacaattcttaggtaaactagataagcacaagtttaatgacatgacgttaacagaagattctgacgatattgcttaaatgcgaactattattgtaggtgcaacggcagctggcacgagtgcagcggctaaggctaaacgaatgaacccagaactagaagttgtaatgtatgaaatgcgggattacgtctcctttggtgcgtgtggcttaccatactttgttggcgagcattttgataatcccaaccaaatgattgctagaacgcctgaagcctttgctaaacaaggcatcgacgtgcaattagaacatgaagtcgttgcggttgattttgacacacagatggttactgttcgtgatttaaaaacaaagcaagccaaaacagagcattacgatcaattaatgttagcgactggggcaaccgcagtcatgccaccgtttgaaaatggtcagttagataatatttatcatttacggacgttggctgatggtgaagtactccgtcaattaggccaaacacctgaaattcaatccgtaacggtgattggtgctggctttattggcttagaaattgctgaagagttccatcaattaggtaaaaaggtacgggttattcaattagaagatcgcgtcttgccacttgcatttgatccagaattaacggctatgatggccgctgatttacgcgataatggtatcgagttacgattatcagaagccgttcagtcatttgaagggcaatcgaaggtaacgggtgttgtaactgataaaggccgctacgcaacagacttggtcgttgtcgcagctgggattcgccctaatacgcaatttattacggatgatcggcttaaaaaacttaaaaatggtgcgattgtcgtcgatcaaacagggcggacatcaatcgaaaatgttttcgcagcaggcgataatgccacggtaattaacagtgtgaccggcgagcccatgtattctgctttagccactggtgctaacaagttaggtcgcgttgtgggcgttaatttagcggggcaacaagcgcaattaccagggatgctaaattcagccggggtcaaattagtgacccttgaagctggacggacaggattaacttctgccgaagcacaagcagctggcattgattatgatactgttttgatccacgataagaatcataccgattattatccaggacaatcagaactgacgattaaattagtttataaaaaagcagatcatgttttaattggtggtcaaattattgggcaaaaggatgcagttttgcgggttgatgtacttgcaactgccattcaagcgcaaatgacaactgagcaattgggactgttagacctcgtctacgcaccgccatttgcaagaacttgggatgcattaaatgttgccggaaacgtggctcattagatgaacaacacgaagagtttaattgcacttggttcaggtatcttaggagttgctgggattagtttactcagtgcaagtcaagccaacgccgcaaccgcaacagtcaattactcagctggtgcaacgacagtttggacaagtcctgaaaccggccaagcagctaaacgatacatttttaaagggcaatcagttaatctactcgcttcacaaaaagtaggtgctgaaacttggtatcggattggtaacggcgaatgggtgccagaacgctatttgacgactgctaaggaaacacctaaggcacaaacagatgctgctaaaacgattcgtgttgctttcgcggatggtgccataactgtctggtcatcaccaacttatacacaacctaccggccgttatatgacttacggtcaaactgaaggcgttataaaaacacaaactgtctcaggtgaagaatggtaccaattagctaatggcggttgggttcctgctcgttttacaggtgaaggtcaattgaagagcacacctgttgttaaacaagcagcaacaccaacgcaaacaacacctactcaagcaccagttcaatcaacgactgctgctaaggtagtgacgccagccgctgaaacagtaacctcagaaaggacatcggtagcaataccagcgccagttgcctcatcatcagtttcagaaagtgttgcttcaagtacacctgtctcagaatcaacagcagctcctgttgcatcagaaagccaagctgaatctatttcagcgccagcagcctcatcatctgtcgttgaaagtagtagtgtaacgtcagaatcaacagcgccggttgctgaaagtagtgtgacatctgaatcaacagcaccagctgttgaaagttcaattgcaccagcacaaagctcatctgcatcagcagtagaagtacctgctaaagaaacggttgaatcagcaccacaagcgacaccaattcaagcagaatctgcgactgtttcatcaacgacaccttcaacgccagttgttgaaagtagtacacaacaaacaacacctaaagcaccagcacaacaatcgtctgttgccgaaagcaaaccagctgttgttgaaagtactaaaccaacaacgccaacacaaacaacacctacaccagcgcctacaacaccaaaacctgcaacgccagcaccaacaactggtaatgcacaagctgttatcaatttagcaatggctcaaattggtaaaccttatgtttggggtgctcatggcccaagtagctttgattgttctggtttgatggactatgtcttccaaaatgcagccggtcggagtatcggtggctggacagtccctcaagaaagtgccggttattctgtttcattaagcagcttacaacctggagacttattattctggggtgcacaaggcagctcataccacgttgctttatatatcggtggtggtcaatacgtccacgcaccacaacctggtgaaaatgttaaaattggttcaatgcaatattacacaccaagctttgctaaacgtgtcttctaaatgaaaatcggcgtacaagcatttattaatgaaattcaagatcaaacttatttaacagatgaatatgaaatagcaacacccaacccatttgtggcggctgactttttggcacagttgaaacccgctgtcagtaaggctgttgaaaaacaagcattggcttctttttcagcattgaccacttatgaaggcgaacaagtgaaggtgacgctagaaacgggcgttgtgaatttaccattacaatacatcaaaaaggttaaccaatttttagaattagaagcacaagcagaagtgaatatttatctttatgtcacttcaccactagtgaaccgctcgggaatgcggattgacctcattgggactgttgctgactttgaagaacaagctgatcaagcatgggccaaagtcgaacaactattaacacaagatttagaagctgttgaagcaggtgctaagttggccaaagaagcgccagttgaagcctctaaggcccctgctaagaaaaaagtaacacctaagaagaaaacggcggctaaaaaaacaaccactaagaaaaaggcgacaaccaccaagaagaaaccagcaacaaagaaaacaacaactaaaaagacagccgctaagaagacaacgactaagaaaaaaagtgacgcttaattaatctgcttgttcaattgcttgttggattggtaagtcaccatttacaaatgaatacttgtggtgaattgtttgttctggcttttcaagaacggcttgaatcattgctgcaacatcagcacgggcaactttcccgccagttggttgcatagtgaattgcgctgtaccggcatcattggttaatgtgccgggtctgaggatagtccagtccaaaccagagaattcaagccagtgatcagcgtagtatttagcggcataataaggcttgatgctttctggccattttgcgcggtcttcaacgaagagtgcactgaccatgacatagcgtttcacatccgcgattttagcagccgccatacttttaacagcgccgtctaaatcgactaatagcgtttgatcatcaccagttttaccaccggaaccagcggtaaagacgatggcgtcatggtcagcaaaaagaggtgctaattcttttggttgtttcgttaagtcaaatgaaacgggtgtcgcacctaatgctgtcatttcagatgcttgtgcatcattgcgaatacctgcagagacgttgtgacctgctgcaacgagtttggggattagtaattgaccaatgttaccatgggcaccaataacaaatattttcatatgacaaaccaatatcgtagtgtttttgatattattggaccgattatgattgggccttctagttcacatactgcaggtgcagttgctatcggacacgttgccaatcgactttttcatgcgccaattaaaaaggtgattgtgcgctattatgaatcttttgcacagacacaccaaggacatggaaccgattatgccattattagtggcgttttgggattcgatcccgcggatcaacgggtaccaatggcggttgatttagcacgacgccaagggattgaagtcgaatttattgaagaccctggtgacagtccagtcaatcatccgaatactgctgaattaacacttattaattcgcaaaaatcattaacgatttggggttgttcaattggcggtgggacgatcgaaattcggaaggtcgatttaaacggcattatcttccaaccagatggcccactacccattattttcgtcgaatctgatcaagaaattgggacagctttggaccacatcttcaaggataattatcggggtgctcggatttcggttcgtgtaccaggtcggttcttgtataaattagaattacttgataagccttatccagaacaggttgaacaggttcgtggtatgagtaaagatatgattgtattatagatgtacacaaaaattcatgaattagttcaaacagcgcaagaacggcagttacctatttcggaattaattattgagcaagaaatccagatgagccattctagtcgagaaattatctgggcaacgatgggcaaaaacttagatgtgatgcttgctgctgaagaaaaaggggtaaccggtgaaggcgttcagtcagcaactggaattaccggtggtgaagccgttttgatgaaacggtatcgtgaaaaagggcaatcactatcaggcgatatcatgttggaagctgttcaaaatgccattgcgacaaatgaagtcaatgcgtccatggggattatttgtgcaacaccaacggcaggttctgctggtactttaccaggtattttatcagtgattacgaaacagttatcactagaccgtgatgcgcaaattcgtttcttattttgcgcgtcagcttttgggatggtcgttgctaacgatgccatgattgctggtgcaacgggtggttgtcaagcagaagtcggaagtgcctcagcaatgggtgcggccgcagcagtcgaagcagctggtggaacaccacaacaatcttcagaagcttttgcaatggctatgtctaatttattaggcttggtttgtgatcccgttgcagggttagttgaagtaccttgcgttaaacggaatgtgattggttcagtcaacgctttaacaagtgctgatatggcacttgctggtttagtaagtaagattccagccgatgaagtcattagtgcaatgaagagtattggtgaaaacctaccttcaacgctaagagaaacgggcttagggggcctagcggcaacaccaactgggattgcgcttaaaatgcaaatttttggtcaagatatgagtattgataaataaatgcaaaagaagctttcaaaatcagcatacggtggcgtttcgggagaaaagtatgtcccgtatgtcagccaaggtaataagaaagtcggtaatacagccattttaattatggggagcttattagctattattttcgcagcttccacagcttattcaggaatgaaggccggtttaactgttgcggccgggattccgggttcaattattggttcaggtttagttggggctttcgctaaatcaaaagggattttaggtaaaaatatcatgcaagggatgtccagtggtggggaatcaatcgccagtgggatgatctatgttttaccagctattgttttaatcggtggtcatattaactttatcgaagggttaattgttgggattttagcaattctcttttcaattgggacatcttcattagtgcataactacttagttgttgaagaacatggtaacttggtttatccagaagccatggcgatttcagaagcgttagttgcttctgatactggtggcgattctttgaaatatatgggaattggctttggtatcggtggcgttattacgatgttaacaacttctgtttttggtgttgttaacaacatgatgaactatgttggctcatcattttataaatggaaattagacgttgaagttaaccccttactagctgggattgggttcatcgttgggttagaagttgcattaacaatgtttgcgggtgctttattatcaaactttgccattgcaccacttatcggttactttactgatatggctggcaacggcgctcacgtttggaataacgcaagcttagctgttaaccaaatgacagttaacgatttagcaagttcatacgttaaatatattggtgctgggatgatgctttgtggtggtttaattggtgccattaaattaatcccaacaattgtcacatcaatcaagaagacattaaacgctaaaaacacaacaggtgaagataaaaacacacttggcatggtttcaattgtacttggtgctgttgggatttttgtaattggtattattattgcccaaaacttcatgatggggattgtcggtgcattattagctgttatcttaagtttattatttgttatcgtatcagctcgaattgccggcacaattggttgttctaacttacctgtatcagggatgacaattgcttcattagtgattatgacggttgtcttcgtcttattcggttggacaagcaatgcgcatacacaaatcttattaatgtttgggactttcgttgtgacagcaatcgctgttggtggtggctacatgcaatcacaaaaagtaacttatgttatcggtggttctaaatcagaaatgatgaaatacttcatgatttcagcatttatcggtgttgttgttgttattgggacaatcagtatcttatcaccacaatttgttacagacagtgcaacacctgcttttggtttgccacaagctaacttaatcgcaacgttaacatcagggatcatgtctggtgaattaccatggattatgattatcgttggggttgcaatggccattgtattatacttcttagaattaccaattatgactgttgcaattggtttttacttaccaatttcaacaacatcaatcattttaatcggtgctttaattaaagtgttcatcgataaagttactggtgatgaagctgttaagaataaccgaatccaaagtgggattagtttatcttcagggttaatcgctggtggttcaattatcggcttaatcgggattatcctccatgtcacaggtgttctaaaagaccgcgtgatttcagggtttgcaagcagtaatgaaatggcattgattctcttagttgtcatgattgttgcgattgcagcaccattgatgatgatcaaaaaaggaggagatagcgaagatgaggaagcaaaaggctgaatgaggaagcaaaaggctgaggttgatttaaatcaactaatctttgctaaagtaccagaagttaagtttcaattaaaagcgggacaggtaactattattcgtcctcaggatcattggattcaacgattctttagacggttacacatcagaattccagctgaatcaaaattgacgctggatgattatggtagtttcgtatttagacacgttaatggtcagcggagtgtttatcagattggccaagcactcgcagccgaatatgatgaaacaaacgactatctatatgaacgattactcgtttatttaaatcatttagaacaaactgaacatttaatcaaacgtgtgacggattgaatgacagacagaatcgagttatccgcatgtacttcaatgatggtgggcaagaatgcgtcaattgatggctctacgatgatttcgcgtaatgaagatcgcttttatgcgatccaccctaaacgtttcttcgtacaaccagcagtgcacaatcggcatgaaacatatgtttctaaatataacgggttaaccatgccattaccagaagaaggttatcgttatacttctacccctaatggtgatttaagtgatggtttgaatgaagaagacggcattaacgaaaaaaacgtcgcactttctgcaacggaaagtgtctacgctaacgaacgggttttagcatacgatccgttgattaagaatggtttagcagaagactcaatgtgttcactcgtattaccatacattaactcagcacgtgaaggggttaaattgatgggcgatatcgttacgaaatacggctcagccgaaggtaatggtgttcaatacagtgacgaaaatgaagtttggtatcaagaaattgtgacaggtcaccactgggtagctgttaagattccagacgactgttacgcagttgcagcaaaccaagttgcaattgaaaatattgattttaatgaccctgataactacatgtggtcagaaggcattcaagaatttgttagtgaaaatcacttgaacccaagtgaaacagaatggaatttccggaaaatttttgggacagatacggaaaaagaccgtcactataacacaccacgtgtttggtacgcacaacgttatctcaatccagaaatcaaacaagaaccagaatcaagtgatttaccatttatccggaaagcaaaccgcaaattaagtgtggaagatgttcaatatgtgttaaaatcacattataacgaaacagaatacgatccacttggtaatgggacggaagaacaaaagacgacttatcgtgcaatttcgctttcacggacacaaaattcccatatttgtcagattagaaataatgtgcctgatgcggtgaaaggtgttcaatggttaggttttggtgtaccgacattctgccctcacgtacctttctttacgaatgcaaatgatacggatgaaacttatcgtgaattgccagaaaagatgaccttaaagaatgcttattggttacatgaagcattagcaatgattgttgaatcgcattatggtgcgtttaaacaagctgatatcgattatcaaaaagcattatcagaatgggcaagaactatgattgctgcaactgataaagcaattgaaaatcaaactgacgccgtagcctttttgacagctcaaaatcatgagattgcaacgcattataatgaagcaacaactgatttgttagcacagttagtcacagaaggtacacaattgtctaagttgacctttgtaatggataagaatctttaaatgactgatttaaaaatgagttccaagcggattgtaatcgcaatggtgtatggctttttagcagcggtcagtgtgaatctattcttgattcctgctaagacgtattcaagtggtgtgacgggggttgcacaattattaacagcgctagtgtcacaccttggtggttctttgagtgtggcggccttagtgtttatcctgaatgtgccgctgttagtattggcatggtttaaaatcaatcatcaatatgcaattttcagtattgttgcggtttttacaagtgtcatttttctaaaaatcattccagtaccagttcaacctattttaacggaacgctttgcgggtgctctgtttggcggggcattaattggccttggtgttggtctttgttttagagctggtttttcaactgggggaacagatgtcattgtaacgcttgtcggtcgattgacaggtaaacgggtcggtgttgtgaataacgtcattaacggcatgattatcctcgctgccggcattttctttggttggggtgctgctttatatagtatcgttgaaatcttcgtatcgagcctgttaatggactatatttacacacaacaacaaaaggtgacagtaacgatctttacaaagcagccagaggcattaaagaagcgaatgcgcgaatttatccatggtgcgaccgaattagatgggacgggcctatatacgaatcaggagacatctgtgattatgacggtcgtttctaaatatgatttaacggctttgaaattagtcgttcaagatgcagatccaaatgcgtttgttaatattcaatcgacgatgaacttatggggtcgttttgaaagtaatgaataactattttgttttagcggctttcaattgtttaagattaacaacaatcttgttgtttaattctgaaacgttagctttatcaacggcgtcgaaatccgtaattgtgactaaagctgagttttcgtataccttttcgacagttcctgtaaaagctgactctagatcttcgttgactttaccagtgacgagatcaccgatattgagattttctttatccatatggaaccttacttagttttttcagatattgatgggactttagtgattgatcaccaaattgtaacgccatttaccaaacgggttattcgaactttacagcagcgtgatgtgattttttatattgcgacagggcgcatgtataatcttggtaaagtaattgcacgtcaaattaatgatgaagcgcggatcatcgcttctaatggtgctgttttcgaaaatgaacagggaagcgttcaacatcatttaggtcgcgcggccttaaaagcggcttatgaaatcacgcaatcagattccagattatcagctcacttttttacaactgatgcggcctattatacgcgtgaaatcccacggttcgtcgcacgcgatgcggggaatctcactagtatgggggctgaaattaactatgattcggtcgctgatctagatagtttgctggcaatgagtgatcaaattattaacggcatcattgtttgccaaggtgcaccggcactattggctacagttaagcaacgccttgctgagcaagatgtaatgagtttatcatcatctggtccggataatatcgaattaattcccaagggaatcgataaagcgacggcgattcgccaaattcaaaccttacatgggattgatgcagatcatacttttgtttttggggacggtcaaaatgaccttggcatgttgcgagctgctaagtatagtgttgccatggggaatgctttgcctgaagtcaaagcggtcgcaaattatgtgacggaaaccaatgtgaatgacggtgttgccaagtttttacaacaacattttgagctatcattatcagattcagaagttggtctttagttaggcaatcgtttccttggttgttgtaacgttctgatagtattgatgatctaaatcagcaattagcgggctgagggtgtcaatccctaacaaagttaagtcatgcattgcacgcgtcatcaatgtatagagtaagtcaacgtcgcttgcttggccgaaggttgttgctgaaatatcgtagccaatgacggcatcgaattcaagccctttagcgaggtatagcggtaataccaagacgccttttggcaatgagcgggtggtctcggagatgagcgttacctgatcatcgggggtgaggctggcgaaaagttggcgcgctgtttgttgatccttggttaaaatggcgatggttgcatgccgcttttgcaggtggaaaatttcctgcgtcaaggcatttaaactagcagctttggtggccgtgataacgcggggaagccgaccgtcacgactaaaggcctgcaaggctgtttctttaggcagtagggcctttgcaaaattcgtgattggggcagtcgcgcgataactcttcgtcaaactgatttggttagtttttagttttggaaaagccgcacagaggcgctcgatgaaattaccggcttggtaagtagcggtaaaaacatcttgtgcgtaatcgccaagaatcgtgaatttagcgttgggaaaagcatgctggagatagacaaattgcgcaatgctataatcttgcatttcatcgatgaataagtactgaatactgtgattttgaccactatcggttaataagtcacgaagatataaaataggggctgcgtcactcaaaccaacgagatggcgttcattattttgggcaactgtttcaatcattgcagcccaaacggcggacgggattgtctcaggacaggctgttcgtaagaagttttgatattcagtatacacatccaagaagtaatcgttataaatagcatcgtataaatcagcaaaataattttgaacaatttcccgggcaataaaagcttgctctaaatcgccggaatcaaattcgcgatcaccgacaatggcgcggtagtcatcatcggataaggtatcaattttttcagcgacccaatcaaggtgcacttctaaattgatctggcgtttgagccgcttaattaaggtgttcttagtagcaataaatttatcaccaggacgcatgttatgtggaaggtcgagatagattttattgatttgcgcttttgtgaagaaaggccgatcttcaaagtagaggtcattgaaggcaagcggttgtgtagaaacctgtttaacgtaggccgcaatttgttgcataaagggcgcactttccttaaagcgacgcattgcttgggtcatttctgggaaacttgcttgatctttttcaaagcggtcgaagagtgtttcaacttggagtcccgagaaacggtggcttaaaaactcagccattgtcacttggcgcatgtttttctcgcctaagctggggagaacgtcagaaatgtaatggctgaataaacggttaggtgaaaaaagaaccatctggtcggcttctaagttgctacgactgtgatagagtaagaaggcaatccgttgtaaaaccgcagaagtcttaccactaccggcgacgccttgaacgattagtaaatcggcagtcgtatcacgaataatatcgttttgttctttttgaattgttgcgacaatattttgcatatattcgtcgctttgttggccgaggacggcttgcaggagttcgtcaccaaccgtttcgtttgtatcaaagaggtgttcaatctgaccgtttttaatcttgaactgccgttttaaagttaagtcaactttaacggggccgttgggcgtatcgtaactgacggttcccagtgtgccattataatagatactagcgatgggtgctcgccaatcataaactaaaaattggtcttgttcgttgataaaagtggcggttccgatgtagagtgattcttcttcaccgtcttcattgatatcaatccgaccaaaatagggggagtcaactaaatccgttagtcgtttttgttgtgtcgttaggagtttctcgttttcaacggcagctgcgaccagttgcttttgctgttggacagcggcattggtttccatccggtcatcaacttcggtaatgttaaccttggtagtatcaccgtaacgttgctcaatatctttagtttcattataggcgttgtccaattgttggttgataaccgttagccgttgattgacttggtcaaccgttaaatcaacacgagcttgttcttgttgttgcgtttcttcttgtagcatatggcaaaaaaaattatcttaaccggcgatcgaccaactggtaaactacacatcgggcattacatcggttcattacgtaaccgggttgcgatgcaagactcaggcgaatacgaaacattcattatgattgcggatcaacaagccttaacagataatgcgcgcgatcctgaaaaaatccgtaatagcctcttccaagtggctttggattatttatcagtgggcattgatcctgctaaaacaactgtttttgttcaatcacaaattccagctttaagcgaattgacgatgcattacttgaatcttgtgacggtatcgcgtttacaacgcaatccaactgttaaagctgaaattcaacaaaagaattttgaacaaagtattccagctggcttcttaatttaccctgtcagccaagctgctgatattacagcgttcaaagcaacaactgttccggttggtgatgatcaagaaccaatgttggaacaaacccgcgaaattgtccggacgttcaacaacgtttacggtcaagaaattttggttgaaccagaaggcgtcttcccaccaaaaggtgaaggtcgtttacctggtttagacggtaacgccaagatgagtaaatcattgggcaatgccatctacctatcagacgacgctgaaacgcttgaaaagaaagtcatgtcaatgtacacagatccattgcacatcaaagtaactgatcctggtcacatcgaaggcaatacagtctttacttatttagatgcctttgatgacgaccatgaaaaagtggctgaactcaaagcacaatatcaagctggtggtttgggtgatgtgaaaatcaaacgttacttaaacgaagtcttgcaagctaaattcgcaccaattcgtgaacgccgtgctgaattcgaaaagaatccagaagcagtttacaagatgttagaagaaggtagcaagaaggctaacgcagttgcagaacaaacactgaaagaagtgcgtgatgcaatgggtattaattattttaactaaatgcatgatttaacaaagggaaatccgctgaagttaattataatgtttacgggaccattattgattgggaacatcttccagcaactgtatagtgttattgacacgctaatcgtaggtcggacaattggggtcaatgcgttggcagcagtgggctctaccggcggtttaaacatgttaattattggcttttgtactgggacgactgcggggctgtctatcatgacggcgcagcgctatggcgcccaagattataagggtgtcaagcgcagttttgccacgagcattgtgattagtgccgtgattacgctcatcttaacggttattagcgttatctttgcccggcatatcttagtcatcatgaagacgccggcaagcattatcgttgatgcgcagaaatttatcacgattatttttgcggggatctttgcttcgatggcctttaacctgttatctaacattattcgcgcactgggtgatagtcggacaccattatttttccttgtgattggggtaatcgtcaatatcttatttgactttatttttattttgggattacacatgggtgttgaaggcgccggctatgcgacagtttctgcgcaaattattgcggctattttatgtctagtgtatatctatcggcgcattccaatccttgtgttgcgtcgtaaggattttaagattactaaaaaggatattacggaccatttaaaggtcggcttaccgatgggattccaatcatcaattattgcgattggttcaatcgtcttacaaattatgcttaatacgttaggtgccagtgccgtggcggcctacaccgcagctggtaagattgatcaattagcaacccaagttgggaactcatttgggattgctttggcaacttacgctgcgcaaaactatggtgcacgcgaatatggtcgaattagtaaaggggtccgtcaaacattaacggtctcgattatttttagtttagtgatgggcgcgctaattattatcttcggtcggccattggttaaccttttcatcggcgatcaacaaccgcaagttaccgccttggctcaaatctacttccgctttaatagtagtagttactttatcttggcaatcttatttgcgattcgctataccttacaaggtctggggcaaagttttatcccaacattggcggggattgcagaattatttatgcggatctttgccgggattatcttagtccgcatgttgggcttcaccggtgccagcatggctaacccgcttgcctggattggctcatgcttagtgctattgagctcatatttcaagacgatgcaacaattgaaacgacgggcagctaaacaaaccttagaaaaggagtcacaggatgtttaaatgtttaaaaaacgattcattggcgttgttgcgctattagcacttgtattagcgggctgtcaggatgaacaaacaacgacccataaaccgacacaaacaacgacgactcacaagcaaacaaaaacaacgaccattttagcgaataagacgtttaaaagtggtgataagccatatctggttgttaaccataacaaaccgacgttagatgtgcgccaatggcaaaccgaacggattaaatatggggcgttagacgatttgaatcggacgacaaccaatacagcttatttatcacatgatacgttgggacgttccaatacacgtgaacgccaaaattggcggccaaccggctggcataaccagcccgtgatgattgatggccaccgagtaatacctcagaatcgtggtcatctgattgcctatgcaatatcttttaacttcgatgaagatggtatttttaagaagggacaattgggcagtagtgacaatcctaagaatttagccacccaaaccgaattcagtaaccagcggacgatgcagatttttgaagatcaggttcgccaagctttaattcggcataaaaaagtgatttatcaagtgacgactgttttccgcggatcagaattgatgccacgtggttattgggtacaagcaatttcaacagataagacattgaattttaacgcctatgtttggaatgttgagccaaagatgcagttcgattatgcaaccggccgtggtcgtgttgatcaaacaatgaaggttgccgattattacccgggcaatcgttatacaaaatagatgatgacagtaaaaaaagcacaagcaccgattttaatggcaactttaagtccctaccaggaagcatattttgaaacggatgaagcctatgaaaatcagttaattactgagatgccgttaaaagaagtcacaattaatatggcctatttcaagggcagccactttaaaaatgtgcaatttgaacaggtgacgtttgataattgtgattttcaagacgttttttttgagcattgcgcgttattaaactgttcgtttatcggcaatacttttcagcgagtggcttttgaaggctgccagttagtcggggctgattttgccgaagctggtttgcgggatgtccgctttgttgcttgcaaactggattatgcggggttcaaccaaacacgaatccgacatgtggattttgaagaatgctcgctacaagaagtggcgtttgaatatgtcgactggcagtggttgacgatgagcggtaatgatttgaacgggattgatttgacggggactaatttaaaacagtttgatttgagtcagaatacttttgaaaaggcagttttctcactcgatttattgcgtggcgcaaccgtcagctctgcccagacgttagtcattatgagtgctttacgaattaatgtgcgttagatgaaaaatttgggtagacgcatttatcaaggaatccagcgccatttaacactattaaaaggcctcttcatcttatcagtcttagtatttgtgatctttgaagtcggtcgtatttttcgagatctcaacggagaacaattacgcgcaagtttgaccacgcagagtccggtaacgttactagcgatgctcgtaattggttttttagcgatattaccaatgctcaattacgactttgtcattgcggagttgttaccagaagagtattcgttttggtataaggtcaaatcggggtggattgttaatacatttacgaatatcgccggctttgggggctttttaggtgctagtttacgggctaacttctatggtaaaaaagcctcacaaaaagaaatcttaattgcaatttcaaagattgcgctctttttattagctggtctttcgatttggtgtttaattagtatcgtcttaatctttggctttggcattggtcaaatttatgccaactattggttatggttagtcggcggggcttgttatttcccagtattactcgggagtactcgtctgaagaacgcggcattctttagcgatttatccgttaaacggattttgcgcttaacggcaggctcattctttgaatggggttttgctggcggcttcttcttgctgatcggttatttcttagaaatcaaaggtgacttattacaagttctaccattattcatgattgccaacatcattggggtcatttcgatggtgcctggtggtttagggacgtttgatttattcatgatttttgggttgagtgcgattggtgttggcaatgctgatgccgttgtttggttatcattctaccgggtgttctactatatcatgccattcttggtgggggttggcttatttacccacgatgcgggtagtcgcttaaatcactaccttcaaggcctaccacggcagattatgcaaaaaatcgcgcaccactttatcgtctttttcctctatatttcggggattattttactattagtagcgactgtgccaaactttgcgattaccaataccgtgattggtcaactttatccttacacgttctttttcctagaccgggtgacgaatattatcgtggcctttgtcatgctagggttagcacgcggggttgctaaccgggtaaaacgggtttattggccattgatgattttattggtgattgcgattgccaataccctatggcgtgacttctcgattaagttggctgttttcttgatccttgtcttattagctagccttttattgaaacgggaactttatcgtgaaaagattgaattctcatggaatgatcgaatcgtcgatggtgccatttttgtcggcgtcttcttgctatatagttttgtcggaatcgcgaactcaccacacttgcatcaccgtaaaccagtaccaacggcgttattattcccgtcggaacgaatttggcttgtcgggtttgttggcttgttagtggcagcggcaacgttgttcatcgttttccgctatctaagtcgtggtgggcataagatcgcaacaccgtttgatgaagcgcgcattagcaaggtgatttcggaatacggcggcaatgaagttagtcatttggcttatctaaaagacaaatcagtttacttctatcaagaagatggcgaagatcaagtcttcttgttattccgaaaaaaagcggatcgcttgattgtgatgggcgaaccagtcggaaatccagacaagttcatcgatgcgattgaagcattgatgcgcgaagccgatttgattgattgtcatttggcgttctatgaaatctccgctgagttaacaatgcaattacatgaaattgggtttgatttcatcaagtttggtgaagaagggtacgtgaagctggctgactttacgttagttggtaagaagcgccgtgctgagcgggccttgatgaataaatttgaacgtgaaggttatcagtttgaattattgacgccaccattttcagatgacttaatggctgaattgaaggccgtttcggatgattggcttgatgggcgggttgaaaaaggcttttcactgggcttcttcgatcctaattatttacaacaggcagccatcgctgtgatttatgatccagagcatcggattgtggcttttgccaatgatatgccaactgggacgaaagaagtttcaagtattgacctcatgcgccacagaaaagacgcgccatctggtataatggatgaagttttcattagtctttttgaacacaacaaagcagaaggttatgagtacttcaatttagggatggcgccactggccaatgtggggacgtcagaattcagttttattgaagaaaaaatcgcgcatttgatttatgaatatggctatcacttctacggcttccaaggcttacggacgtataagaagaaatatacgacgaagtggattcctaaatacattgcttatcaaaagcggacctcaattatctttacgatgctccaaattctattagtggtgaaccaaaaagtgacggagacaccacaacgaaaaggactcgcaggtcattttatgcgttttgttcaaatcggcaacttaactaacaatcaagacaaatgaatgacagattattattattcaaaaaatccggaagttgaacacgctgagaaaaattggacgtttgaactacggggctttaatttcaagttcacgactgacaatggtgtgttttccaaaaatactgtggattacggttcacgggcattgttagatgccgttgatttaagcgagacgccagcaggtcccatcttagacatgggttgtggttacggcccaatcgggatgacacttgctaagttagcacctgagcgtcaaatcgacatggtcgatgttaacgaacgcgcgcttggcttagcacaaaaaaactgcgatttgaatcaaatccaaaatgttgcaatctttgaatcagctgaatatcaaaatgtgacggcgcaatacgctgcgattttgacgaacccaccaattcgagctggcaaagcagttgttcaaaatattttgaagggtgcctacgatcacttgctaccagatggtgaattagacgtcgtgattcaaaagaagcaaggcgcaccttcagctaagcaattaatggcggatacttttggcaatgtacaaatcattcataaggataaaggctactatattttacaaagtattaagttaaaataaatgaaaatgagatataagattctaattggtgttggtgtcacagcgggggtcggtgcaacagctgctttcgttggttctaaggcaatcatcgagaaagttgaacgctaccgtaaacgctcggcagttaaaaactttgtcaaagataaactacatggtaatcaaaaggcattggaattggttgatcaactttccgatgcagacgtgaataatttattaggggcggctgataagctcaaccaattaaaggataagctaggcgaacaaaccgataatattccagaaatgatggaagacttacggcaaacgttgacggcttatgcgacgaaagtcaaagaacggctataattgattggtaaaggggttagtgaattgggatatacacaaactgagattgatcagtggatgcaagttgcaattgatgaagcgaatcaggcacggattattggtgaagtgccgattggggcggtcatcgtgaaggatggccagattattggtcgggggcacaacattcgtgaacacgcacaggatgcaacgttacacgcggagatcatcgcgattcaagaagcttgtatggttgaaaagagttggcgcctagaagacacggcgatttttgtaacgttagaaccctgtccgatgtgtgccggggccattatcaacagtcggattccaaacgtttattttggcgccagcgatccaaaagccggcgtgaccggtaccttgatgaatcttttgacggacaaacggtttaatcaccaagcgacagtggtggctggtgtgcgcgaagctgaatgtgccgccttattacagacctttttcaaaaaaattcgggaaaatcgacgaaaaaagaagaaaaaaactggtaattttaaacctaatcgggtagaataaatgagctatcaagctttatatcgggtttggcggccacaacggttcgatgatgtcgttgggcaagaaacaatgacccaaacattaaaaaacgccatcatcacaaaacaaacgagtcatgcctatttatttacggggccgcgggggactgggaaaacgtccgctgcgaagatttttgccaaggcgattaattgtcattatcaaaaagatggtgaaccttgtaatgaatgtgaaacgtgtcgggcgattactgccggtgcgttaaatgatgtgattgaaattgatgcggcttcaaataacggggttgaagaaattcgggatatccgggataaagcgaagtatgccccaacccaagccgattataaaatttatattattgatgaagtccacatgttatccaccggtgcgtttaatgcgctgttgaaaacattggaagaaccaccagccaacgtggtcttcattttagcaacgaccgaagttcacaaggtgccagccacgattatttcgcggacccaacgctttaacttcaagcggattacggctgctgatttattcaaacgaatggcttacatcttagaacaaaaagaaatgacctacgatccagctgcgttaaaagtgattgctaaagccgctgaaggtgggatgcgagatgcactgagtatcttggatcaggtcttatccttcagtgataaccacgtcactttagaaaacgcgttggatgtgaccggtagtttgacggaagctttattagccgattatgtgcaaacaattcatgatcacgcgcctaaagcagcgttgcaactattgcaacagatattagctgagggtaaagacgcacaacggtttgttgaagatctaattgaatatgtacgtgatttattgatgtaccaacaagcacccgaattggtaatggctaatgaaatggatctattggacgaacacttcaaacaacttagtgatgccttgagtgctgaacaattgtatacggtgatcgatattttaaatgaaacgcaacaacaactacggttcactaatcatccagaaatctatttggaagttgcaacggtgcgtttgacgcaacaaccagtggcacctgcggccgttagcgccaatgtttcagccccagcggataatgagcaagtgacccaattaagtcaacaagttgctcaattacaagctgccttacagaaattagaaacggccggaccaagtgcgcctgttcaacaggcaaaacctaagccagctaagaaaattagtaagaaggtcaaccggaagttgatttatccggtacttgcggatgcgacgcggactaatttagaaaacttaaaagaagtttggccagatttattaaacatgttagatgttaccaaacgagcgattatgcgggtttctgaaccggtagcagcgagtcaaagtggcgtcgttgtcgcttttaactacgaaattttattcgaacgggctaataacgatcaggatttattaacggttctagaaaacgggttaaaccgtttaacgggcaatccgtttaaagtggtcttagtaccgcaagataattggccagaaatccggaaagaatatttgcaaaatcatgcggtttcaggtcataataatgaggaccaaccaacgacgacgaccgaaaaagcaccggcgcctgaagttaacgaagttgtgcagcaggcccaagcgttattcggggatgcagtcgttgttcaaaaagattaaatgcgcggaatgggtaatatgcaaggtatgatgaaacaaatgcaaaaaatgcaaaaagaaatgggtcaaacacaagacgaattaaacagcactgaattcgttggcaaggctgctaacgatgctgttgttgtgacaatgactggtgacaagaagatgaaagatatcgccatcaaaccagaagctgttgatccagatgacgttgatatgcttcaagatttaatcatcatggcagttaacgaagcaatggttgatatcgataaacaaacacaagctaaaatgggcaagttcacaaagggcctcccattctaaatgcaatatccagaaccaattgcgaagttgatcgaaagttatatgaagttaccaggcattggtaataaaacagcaacgcgattagctttttatacgattgatatgaatgaagatgacgtgactaactttgccaagaatctgatttcagcacgccgagaccttcattattgtagtgtctgtggcaatatcactgatgaagatccttgtgagatttgtcgggatactgcgcgtagtcaggaaatgattttggtggtcgaacaacctaaagatgtgatgtcgatggaacggatgaacgattatcacggtctctatcacgtcttgcacggggtgttgtcaccaattgaaggtaaagggccagacgatattaatattgctaatttaattaaacgactccaaaaaacaccagctaaagaagtcatcatcgccaccaatgcaacgccagaaggggaagcaacggcgatgtatatttcacggctaattaagccggccgggattaaagtcactcgtttagcccatggtttagccgtcggaagcgatattgaatatgcggatgagatgactttattaaaagctgtcgagggccgtcaagaaatctagatgttcggtagacgaaaaccaacgctaagagaagctggcgatgaagcgttacttgatttgatttatcaagtgaaagataagtggcgctcagcacaaaaaacgcaagcaaacgttagaggactagatcaaacgttggagatggaaagtaagattcaacaagcaaagttcgaatttttataccgacaagcacgtcagcgcaaggtggccagtgatgctgtttcgcgtgaagtagccagccgtaatgctttaagataagtggtaggcaaattaattacgtttgaaggaccagatggtgccggtaagaccagtgcactcgaagcagtcgtggcacgcttacaaaaagaagtgtcccaagaaattgtcgtgacacgtgaaccaggtggcaatccaatctctgaacagattcgccagattatcctggatgtgaagaatacggcgatggatgatcggacagaagcattattatacgcagcagctagaagacaacatattgttgaaaagattcaaccggcactcgcagccgataaactcgtgatctgtgatcggtttgtggatagttcaattgcttatcaaggtgctgggcgcgggattggggaagaggcagtggcgcaaatgaatttatttgctactgacggcctcacgccagatttaacgttatacttagatgtgccttctgaagtcgggttagcacggattaagcagcatcgtcaaaatcaatatgaccgtttggatcaggaaaaattagcgttccatcaaaaagtgcgccaatcttatttgaagctagcacaagcgcacccagatcggattaaaacaattgatgcctcacaaccccttgaagcggttgtgacacaatgtttacaagtcatcgcacaagcaaatccgcatttatttgaagtataaatgaaattattattagcaatcgtccaagacaaagacagtaacttattaagtagtgaattaattgatgccaatattcgagcaacgaagttatcaacaactggtggctttttgaaatctggcaatacaacgtttatcgtggggattgaagacgaacgggtcccagaagccttgaagattattgaagaaacatgccaagcacgcgaacaatttatgacacctcctatcaatatggatgccacaatggacagttcaatgtcttaccctattgaagtacaagtcggtggggcaaccgtctttgtgatgccaatcgaacaattccaccgcttctaaatggccactttaacaattgaacaaatgcaacccaagcttgtccagcagtttgcccagattattgcgcgtgggcagttagcacatggttatttattagccggtgcacaaggtgtgggtaagatgcaattggcacaatggttagcactacgtcttttttgccaacaggtcaatgaagacagccaaccgtgctatcaatgtcctgaatgccagcggattttaactgggaatcatcccgatgtcgtcgaaattaaaccagacggtaagagcattaaaattgctgatattcgctatctgaagcaagaagttgctaagagtgggatggaatcgagtcagcggcttttcattattgaagcggcagagacgttgacggctagtgcggccaatagtttattgaaatttttggaagaaccggcgccaaacgtctacgcaattttatgtaccagcaataaaaatctgatgttaccgacgattttatcgcggcttcaagtgattgacttagccaatctgccgaaggaaatggtgcgtcaacaatttgaagaagcgcagattttaccagcgcaggcacagctgttgagtcacttgacgagtgacttaacgcaggcccaacaattattggccgaagactggctgatgcaagtcgttgctaaaatcacgagttgggcccaaaaagttgcccaaaaggatttggagagttttgtaacgattcaaacgcaactactacccttattgacagatcggtcccaacaaaagattgctttaaacttaatcggtttgtggtatcaagatcttttaaactgccggtatgatttggcgggtgatctttgttttagtgagtatcgcacacagttaaacaccattagtcaacaaatgaccgcggcggagattgtggcgcaaacagaattcgttttaacggctcaacgcacgtttgaacaaaatgtgagttgccaaaacgtcttagagagtttaacgttaaatttaatcgcagtagcatagttgagtaaaacagacttatacgaacaattattaactattgagcagcaggccaagttaacgtttgacggcatcactgaaatgaaggcagttttatctaaagttctggaagaaaatgcagaattagagattgaaaataaacacctcagagaacaccttcaggaattacaacaaacaactgaggaaactgacaccaaagatttatcacaaggtttgtctaagtctaaacaaaatttacagaatctgtatgaagaaggctttcatatctgtccttatttctatggttcgcgacgtgaaaacgacgaaccatgtgccttttgtaacgacgttatttatggcgaacggacagctgattaaatgcaaacacaatctagttttaaaacaaccactcaagggacgctctatttggtgccaacaccaatcggtaacttgggtgatatgacgtaccgcgcgattgagacgttaaaggacgttcagttaattgcggctgaagatacacgcaatacgcaaaaattattgaaccactttgaaattgaaaccaaacaaattagtttccacgaacataatacgcaacaacggattgaaacgttgattgaaaaattagaagcgggggacgatattgcccaagttagtgatgcggggatgccatcgattagcgatccgggtcatgaattggtcaaagcttgtatcgaagccaatatcgcagtcgtaccactaccaggcgcaaatgctgggattacggcgttaattgcttccgggattacaccgcaaccctttacgttctttggctttttaccacgcaaaggcaaagagttaactgaaacggtcgcacaactagccttaaagccggaaacaactatcttttacgaagcacctcatcgtttgaaaaagacgttacaagcgttgatcaacggttttggtggcgaacgtcaagtgacgttgggccgagaattgacgaagaagtttgaggaatttattcgcggtgatttacaagaagccttaacttgggcgaccgacaatgaaatgcgcggtgaatttgtgattatcgtagcgggcaatcctacccctcaaaatctaagtgtggtggccaccgatccgtctttatcactatcagaacaagtcgaagcccagattcaacaaggggctagtcctaatgttgccattaaaacggttgctaaggccaatgatttgaagaaacaggttgtctataacgcgtaccacgatttaacagaatagatggcaggcaagcagtacacagaggaataccggattccgtattttgaaacggatattaaaggcgagttaactttggcatctttagtcaacgttttaattttggcctcagaacaccaactcaatgacctcaatgtcggcgaagaaaccatgcacagtttaaatcttggctgggttgtcacgcaatatcaaatgacgattaaccggatgcccaaagtggatgaaaaggtgcggattgtgacggaagcagagagttataatcgctatttctgttatcggaatttttggttgtacgatgaagcgggcaatgagtgcgtctttgtccaaagtattttcgtgatgatgtcttatgaaacgcgcagtatggtgcccgttgttccagaaatcatggcaccgttcgaatcaatggcgatcaaaggtagcaaacgattcccacgcattaagaagatagactcagaaaaggcatcgcaaaaagaataccgcgtgcgttattttgatattgatggcaatcaacacgtcaataacgtccattattttgaatggatgttagacgccttggattatgatttcttgatggaccaccgggtaacaagtgttaatatccgttacggccacgaaattcaatacggtcaaatgacacaaagccaggtcgaacaagtgatggttgatgacataatgaccacgcgccataaggtagccgtgggtgacctaagcgcagcagaagccgaaatcgcatggactaaaagataggtggttaaaataatcaaattatttgctaatcaacatccatatcttgcctatatcgcgttaattgtaactgcgagtttaatcggaattaccgttgaatggcttattaatcgggattttgttaacaacatatggggcgctttaatgatgattataattggggtaattggcatttattataagcaaaaaaagaaatcataattatgagacggcattgctgacgaagttcacgaggtcagcgcctgttttaccagcacttaagccaacttgaagtttcaagcgggctttggggccgtttaaaccttggcagaaagtaatgcccatttttttcaatttaacgccaccgccatcgtagtcgtagacgtcttcggcaataccgttgaaacagcgggatacgagcacaacgggaatattgcggtccagtaaggcttggatggcaggtagtgttgcgggtggtaaattcccagcaccaagagcttcgatcacaaggcctttagtagttggttgattgatggcttcaaacagcgtcccatccatgccggcgtaagcttttaataagaagaccggttcaaccaattcttgaatatcgcagatttcagaacgaattaattcttggaagaaatttgcatcgtgtttgctgaccaaaccaattggtccaaaagtaggtgttctaaaagtagcgacatttgtcgtgtgcgtttttgttacataacgagcggtgtggatttcatcgttcatgacgactaaaacacctttatcatgggcatcatcagaagctgctgtccaaacggcactaattaagttatgaagaccatctgagccgatttcattagaagaacgcatcgcacctgtgatgacaattggcacgttgttaggcaaggtcaggtctaagaagtaggcagtttcttcaagtgtatcggtcccgtgagtgatgaccacaccgtcgatacctgttgcttcagcttcttgaatgcgattcttgagtgctaacatcacggttggtgtaatgtgcggtgagggcagattcgcaaattcttcactaataattgtgagttggttatcgaataatttttcaaaaccggccattggattttgaccagttggtgcgactgcaccgtcttgatcagcggacatggcgattgtaccaccagtgtgcaagacgaggatttttttcatatgctcgcggttttagtcccgcattcgccgcagtgttatttgtggcaactccaaaagggagatgctttttttatggttaatcaagatcggttatttggtgtgaagctagacaccagacgcgttgtattactagctgttctaatcgctttacaattagtgattgctcgctttgcgatttcgctaacgatttacagaattagttttgggtttatcgttaccgccttaatgggttggtggtttgggccagtttgggcgggcttagcggccgtccttggcgatctcatcaatagtttgatgattggtgttccgggcggctatttccccggtttcacgttatcagccttcttaggcgcattcatttacggctgtttcttctaccggcaaaagattacgtggttacgcgtgattttagcggtattaacggtggttgtcgtcgttaatcttggcctaaattcatggtgggtatcgattttaagtcagaccccaatcagtgtccactttgctacaagagcagtgggcgaggccgccacaatggtcattcatccgattgtgatttacctcgtgatgcattttgaaccaattgttcgtttgaaagatagaattcaataattacatagcgttgaacattagatatatattatttggcttatctttttctaacgtaagtgatgtagctgattgacctgcataaccgtattcttttatatgataggccatatattcctcttcggttgatatattgaaatgtgcattaagaacctcaataaaaccatatctggttgttcctggatataattcctccatagaatttccgatagtgtagtgatgacgaccatcttcagtatagacatgatcagtatctgaatatcccgaagtatatttatccatatagctaactttatcgccaactttaccagtaaaggtgcctactttatagaagggacggtgttcttgagaatagattatatatacgttgtatgaaacctggtctgttggttcgggtttgtcaatattgtcattatcttggttgttattggtattaccagtatttgagccgttatcttggttattattggtattaccagcatttgaaccattatcttggttgttattagtattgccagtatttgaaccattatcttggttgttattagtattgccagtatttgaaccattatcttggttgttattagtattaccagcgtttgagccattattttgattgttattggtgttaccagtatttgagctgttatcttggttattattgttactactattgtttgaattactatttacattagtgcttggtgctgtggttgtatcgttaacatcagggctaactggttttgtaacgataattgagtcattgttcttaacaggttgtgaagaatcgagattgtaagcattattatcctcatttttatccttaacaatcacagtgctattaacaccattccacttaaagagcaatgtgttaccagtttcaatcaaatcaacattactaatatggttaatttcagcaagacgtttaatagaaacgtcaacgccatttaatttggctgctgcactaatcgtacttaatgtatctccccatttgattgtatatttatcaatccctgttgtttttaagtcttgtcgaatggcttggacacttctaggcgtccagttcgttgcggcttcaacagagtgacttgcaccattaaaaataggtgctacggttagtaaggttactccagaaacaagtagacttgtactaatcttcgataatttcatatgattaaacaaataggcaatttaatccgtactaaacggttggaccaaaaaatgacaattgaacaactggctgaaaaagcagaattgtcagccagttttatcgctaagtttgaacgaaatgatcagaataatatttcgatacaagcacttgaaaaaatcgtgaatgctttaaatatgaagttgggtgatttattcatgtacgagggtatcagcgatacaacaactttagaattaatcggttatctctctcaattgagtgagacagatcaacaagaattaagtgcagcaattctaaaaatgataaaaattagtcaaaaaaatagtaaatagatgaagctattggcaatggatacctcgaatcaagcggtgagtgtggcgctacttgaagaccaacaaatattaggcgaaatgaccgtcaatattcggcaaacccacagtcaaacattgttaccaatgattgatcaacttttaaaacaaaccaagacaccaattgaagcaatcgaccggtttgtagtggcacaaggacccggttcatatactggcttgcggattgcggttacaacggccaagtcttttgcctggacaatgggtaaggaactagttgggatttctagtttggcacttttagcggggaacgttcaagaaacaaccgctttgattgtgccgctatttgatgcgcgccgggacaacgtttttgccggtgtttatcaatggcaagaccagcacttacaaaacgtggtcgctgatcaacatttggcactaaccgacttattagcacaagtggcgttactaaatgaacctgtctattttgttggcggtgacgtacaacagtttaacgcacagattaaagccactttaggtagtcaggcccattttgtcgatgccaaccataacttgccacacgcagctgttctaggccaattgggggctaatgctgaaccagttgctgacatccatggctttgggccacattatctcagaaagacagaagcagaggtcaactggggtaaaacacatgacgatcaaggatcggcagcttatgtggaacaagtttagatgtggaacaagtttagggaatacctacgcccacgtgtttggttaaaaaaagagctcccctacgttacgcggcaagtcatgattgatgatcagccgttttacttggcgcgtgccagccagagcgatattccagcgttgattgatattgaacgctcggtctatggcggtaaaacaccttgggatcggtgggcctttgctagtgaactcagcaagcgccggacatcgatttatttagtattatgccaaggctcagaagtggtcgcgtttgttggtgcttggttttcaactaatgaggcccacatcacgaatattgcggtccgtcctagctttcaaaaacgagggattggccactttttagtccacgaggtggtcgcacttgcgcgggattatccgagccaaaaaattacccttgaggtccgcactggtaacacaggcgcgcagtctgtttatcgacggatggggtttaaggtcgttaaaaccagacgcaattattatgttcaggaaaaagaagatgcattcagtatgtgccgcatactgagtcaatagatgacggagaaaaaagaattaattttagcctttgaatcaagttgtgatgaaacgagtgtggcggtcattgaaaatggtcaacgtatcttaagtaatgtcattgcaacacagattaagagtcatcaacgttttggcggggtagtcccagaagtggctagccgccatcatgttgaacaaatcacactttgtacacaagaagcactggaacaagctggtgtgacttatgatgatttaacagcggtcgccgtcacttacggtcccggattagttggcgctttattgattggggtcacagccgctaaggcaatcgcctacgcgcatcatttgccacttgtaccggttaatcatatggccgggcacatttatgcggcccgctttgttaaaccgttagaataccctttgttagccctattggtttcaggtggtcacacagaattagtttatatgcccgctgcgggtcaattcgaaatcatcggtgatacacgggatgatgcggctggcgaagcctacgataagattggacgggtattgggtgtgccatatccagctggtaaggaaattgaccgcctcgcacatttaggccaagatacgtttaattttccacgcgcaatgttgaaagaagataacttggacttcagttttagtggtctcaagagtgcttttatcaatacggtccaccatgctgatcaaatcggtgaaacattggaccaagcggacttagcggcaagtttccaagcaagtgttgttgaagtattagtcactaaaacccttcgcgcagcacaatcactaaaggttaaacaactagttgttgccggcggggttgcggccaaccaaggcttgcgagaaggcttagcggctgggattgaatcagcaggattagatcttgatttaatcatgccaccactacgcttatgtggcgataatggcgcgatgattggcgctgctgcccacattgcacttgcgcaaaacacgctggctgatttagatttaaacgccgtccctagtttggactttccgtatcaaaacgaactttaattaggcttcactttgatgtagtcgcgcaccttggctttggtgatgctcacggcgtgcttgatgatgttgacggtatttttctaagcctaagacgatgccagtagcaataataccaacccaaaagagattaggcggtaagaataaaataaccataatcaatccagctaccagtggggcttcaagaatggcactgcccatactgatggcaattaacccaatgacaaagagggaatcaacttgcgggaataactggctaattgccatcccttgagcggttgaagcaaacaaaaccgggaagatatccccgccaagccaaccggtgttcaaacagattgttaataaaattagttttaatagggagcggttcattaaaaaaagcattgattgatcttgccaaattgtggtgaataaatgaaagttatgttgaccggaaaagagaatgtgtgggaaaaagaggctggctaagaaaatcgccagaccaccgattaagacgcggacctgatcgttggtgaggcgggcttgcataattttgcgtaagcccaccatgccggccaaccaaagttttccgagtaaataacccccgagcactaatggtaaaaaccaatagagatcgcgcccttgccagtgcgattggccaagccgaataattaatgacggttcgccggttaagatgaagacgccgctaaaccacgcagtcccatttaaaaagtaagttgtgatgagggctttcttttgataggttgctactttggtgagtggggcggttggttgttgataatgcaatagatagcggtgcggtgtcgcgagtacttttaatctcatgcctattgattgtgcacgtaagtcatcaaaatgcgcggcgacgtagcgttgcttgtcagcgagccaaatactgtagaggaaggttgagctaaccaatgttgcttcaggcccaaggctcgttccgctgaccaaaatgacagcaggaatcagcatttgtaaaaggacatagcgataattagcagtgcccgtttgtttgagatcagccttaatgacccccaaattttgtgggaggggcccaaaatagtgtcgtgaaataatgatgactaagccaaccatcatcagcataatggcgtctaagaggctaccaaaggttgctttttgccagaaaagatcaattagagtactttgtaagctataaaaaaggccgagcaagataccgacgatggcgctcagaataagaccataaccaaatagataaagtgatttaaatttaaacatatggcagaaaaaacaatcatgttatgttgtgcggcaggtatgtcaactagcttgctcgtttcaaaaatgcaaaaggcagcagaagcacaaggtgtcgatgcagaaatcttcgcaactggcgcatcagatgcagataaccaattagaaaacaaaaaaattgattgcgtcttattaggccctcaagtacgctttatggaaggtcaatttaaagaaaaattagcacctaaaggcattggtgttgaagtgattgatatgaaagcctacgggatgatggatggcgaaaccgtcttgaaacaagcgttagcactaatcggttaaatgagtcttttaggcacaattatttggtggattttcggtggcttagtgagcgcagttggttggtttttagccggcttagtgtggtgtgtcacaatcgtggggattccagttggcttacaatgttttaaaattggtggtttgacgttaatgccatttaacgcacgagttgtttcgagcggtggtgcaggctcctttttattaaatattgtctggtttatctttgggggctttattttatgggccaaccatattttctggggcttgttattaacaattacaattgtcggcatcccatttgcccaccaacattttaaattagcaagtttatcattgagtccgtttggcaaacaaattgttggctaattaattagtaaattcttcgagtgccatcgcttgttcttcccaatcagcttctgtttgggcaaggtctgcttgcactttttctaaatcttgttgtaattcctgcaagaccaatggtttagtgatgatatcggcttgtgtcattttttcttgaatggcagttgcttgttcttcgagtgttgccatttgttcttctaaagcagtgacttctcgttctaacttccgttgagcccgttgtgtttccttgctggctttataattatcttgagcagtaacaggttggtcactgacttcaactggcacttcagcggcttgtgcgaaggcttcttcctcagcttttttagcgagatagtagtcgtaatcgcctaagtagcgcttgctgccggtggtggttgacagttcaatgatgccggttgccacttggttgatgaaatatcggtcatgggagatgaagaggacggtgccgtcgaattcgcgtaaggcttgttctaaaacttccttactatcgatgtctaaatggttagttggttcatccatgatcaaaaaattatcatggttcatggctagcttagttagtaacagtcgtgctttttcgccaccacttaattgtgaaacgactttcaaaacatcgtcgccggtgaataagaagctgcccaaaagtgtgcggatttctttttcaggggtggtgcgatgttcatcccataattcattaagaaccgttttgttagcgtggaggttacgttgctcttggtcataataaccgatagaaacattgctaccaacacgttcgtgaccttttaagaatggaatttgatgaaggatactctttaaaagcgttgatttaccaatcccattaggtccgataatcgctaagcgttcttgcttgttgacttcaaagttaatgggttcgaccattactttgtcggctgagtaaccaacagccgcgtcaacgacttgcaagacttcgttaccacttggttgatcgatatcaaaatggaagtggattttagaggcgtcgttggttgggcgttctaacttatccatcttttcaagttgacgacggcggctttgggcttgcttagtcgtgctggctcgaactaagtttttgtcgacgaatgtttggagtttctcgatttcggattgttgtttctcataagccttccattcgagtgataggttggctgatttttgcgtcaagaagtgactgtaattgccggtgtagtgcgttaatgtgtggcgactcatatcgtaaacttctttagtaatcttgtctaagaagtagcggtcatgagaaacggttaaaagtgcgccgggataggtttgaagataattttcaagccatgttaaggtttgaatgtccaaatggttagttggttcatccaagattaagacgtcttttttctcaagtaatagcttagcaagtgctaagcgggaccgttcgccaccagatagcgtgctgattggtttggtgaaagtttcttctgggaattggaaaccgtgcaatacaccacgaatttcggcttcgtaaccatacccgtttgcttcagaaaagtcgtgttgaatctgatcgtattgttttaagagggcttggtagtcctcatctgaacgattagcatctggatcggcaattgcttgttctaaagtatgcatctgtgcttccatttggcgaaggccttcgaaaatcgttagcatttcgtcatagatgttccgttcagaactaaggccgctatcttgggctaagtagccaacttggacatttttacccagaataatttgaccatcatcgggcgtcgtaatgctagcaatcatcttcaaaagtgttgatttaccagcaccgttagggccaactaaggcgacgcgggcgtgatcttgcacttccaattgtgcatttttaaataagtagtcaccgccaaagtgacgagcgacttgttgaacctgtaataatatcacatggctgaaaataaaattccaagagccacagcgaagcgtttacctttatattatcgttatctaaactttttaaacaattcgggtaagaccaagatttcgtcaactgaactatctgaagctgttaaagtcgatagtgcgacaattcgccgtgatttttcatatttcggtgcgctcggtaaacggggttatggctatgatgttgagtctctcttgagtttcttcaagaagacgttgaatcaagatcgcttaacgaatgttgctttgatcggtatcggtaatttaggacatgctttgttaaattacaactttagacaaacgaataatattcggattagcgctgcttttgatgttaaacctgaattaattggcacaatccaaacaggtgtgccggtttattcaatggacgaaatggttgaacaattgaagctgcaacaaattgaaatcgtcatcttgacggtcccaattgaagtcgctcaaaaagtaacggatcaactagttgacgcggggattaagggcatcatgaactttaccccaattcggatttctgtaccgaataccattcggattcaaaatgttgatttagcgaaagagttacaaacgttaatttatttccttgataattataatacagaagaagcaccaaaataattaatgactgagataaaagagggttacgacgagattcattcctgcatgactgataatcgttgtataaatggaacccgttttgcgatacagccaacaaaggaaaaggccgattgccgcgtagataattagatgactgtcttgatgaatcacggcaaataataaactagagatgagtgcggctaataccgaatttaagcggccgctaagaccgccaaaaatcgcctttcgaaaaacgagttcttccattgttggcgcagcaatcgttagaataatgatcaaccacggttgggctttgagggccgtcatgagagtgagcgtattgagtgattgcgtactatttttaaagagtagatgatcaattgaaccagcgataatttggacgattaacgcgagtaaaataccactaatgccccagatgatggctttcttaagcggcaaggggtgtttctcaagactatttttttggccccgataattaaaatagagtaataaaagtgcgccgaggctgtccgtgattgtggtgaataaatagaattgatctgacaacccgaaaaagcggacgagggcactcgggattaataaaatgatgagatagctgataatcagcctaaaattttgttggctttgagtcatgtgttaaaaccattagaagatcgcgtagtgatcgccgttaaagacgaagcagaacaaacagtaggtggcattgtcattgcaagtaacgccaaacaaaaaccacaaactggtaaagtcgttgccgttggtgccggcgcaatgaccagtgacggtcagcgaatcccacttgatgtcaaagaaaatgatgaagtcatttacgataaatatgctggttcagaagttgaatacgaaggccaacaatatttggtattacacgcaaaagacattatcgccattattgaataaatggcaaaagaacttaaattttcagaagacgcacgttcaaaaatgttagcaggtgttgatcaattagctaacactgttaagacaacattaggaccaaaaggccgcaacgttgttttggaaaaagcttacggttcaccagaaatcactaacgatggtgtgacaatcgctaaagcaatcgaattagaagatcattttgaaaatatgggtgccaaattagtttctgaagttgcttcaaaaacgaacgacatcgccggtgacggtacaacaaccgctactgttttagcccaagcaattattcgcgaagggatgaagaatgtgacagccggtgctaacccagttggtatccgtcgtgggattgaattagccactaaagaagctgttaagaagttacacgaaatttcacacaaagttgaaagcaaagatgcgattgcccaagttgctgctgtttcatcagctaacgaagaaacgggtcgtttaattgctgatgctatggaaaaagtgggtaacgacggtgtcatcacagttgaagaatcaaaagggattgatactgaattaagcgttgttgaagggatgcaatttgatcgtggttacttgtcacaatacatggtgactgacaacgacaagatggaagctgacttagacaacccatacattttgattacagataagaagatttcaaatattcaagatgttttaccacttctacaatcaatcgtgcaagaaggtaaagccttattaatcattgctgatgatgttgatggcgaagcattaccaacacttgtcttgaacaagattcgtgggacattcaacgtggttgctgttaaggcccctggttttggtgatcgtcgtaaggaacaattagaagacatcgcgacattaacaggtgccacagtgattacaagtgaccttggtctagaattgaaagaaacaacaatcgatcaattagggacagctggtaaggtaactgttacaaaagacgatacaacaatcgttgaaggtgctggtagcaaatcagctatcgcagaacgtgttgaaaacatcaagaaacaaattgctgaaacaacatcagactttgatcgtgaaaaattacaagaacgcttagctaaattagctggtggtgttgcagtgatcaaggttggtgctgccacagaaacagaattgaaagaacaaaaatatcggattgaagatgccttaaatgcaacgcgtgcagctgttgaagaaggctacgttgccggtggtgggacagcattaatcgatgtcatcgaaagtgttgccgctcttgaagaagaaggcgacgttcaaacagggattaacattgtgcttcgtgcattagaagaacctgttcgtcaaatcgcaacaaacgctggtcttgaaggctcagtcattgttgaaaaagtaaaatcacaacctgttgaagttggctacaatgcagcaaacggcaactgggaaaatatgattgaagcgggtatcttagatccaactaaggtaacacgctcagcattacaaaacgcagctagtgttgctgctctaatgttaacaaccgaagcagtggttgctgacaaaccagaagacaacccagcaccagcagcaggcatggacccatcagcaatgggcggcatgatgtaaatgcaacaactaaaacggattttcatcgggaaaccattaaagtcttccgatgaaggtaaccagaaattagggcgcttcaaggccctggcaatgttgtcttctgatgctttgtcatcagttgcatacgggaccgaagaaatcgttgttgttttaacaacgctttctgcagcagcaatttggtattcaattccaattgcagcattcgtattggtgttattgatttctttaaccctttcttatcggcaagttatccacgcctatccaggtggtggtggcgcctatgtcgtttcaagtgaaaacttgggtaagaatgcgggtttagtcgcaggtggttcactgcttgtggattacatgttaacagttgcggttagtatttcggctggtgctgaggcgattacctcggcaattccggcaatgtacgggcatcaggtgggaatttcctttgtcatcgtgattattttaatggcgatgaacctccgtgggatgcgcgaatcggcgtcgttcttaatggtgccagtttacttattcgtcttgatgatgaccttgatgattatcgttggatgttacaaaattttcacaggtgcgattccattccacgcaacagcaacagttggggccgttgtaccagggatttcaatggcattgatctttagagctttctcatctggttcatcttcattaaccggggttgaagcaatcagtaatgcggtaccgttcttcaagaaaccacgggccacaaatgctgctgaaacattggcaatcatggccgctatcttagggttcttctttgccggcatcacattcttgaactactggtacggcattgtgccaatggaaaaagtaacggtcttatcacaagttgcacaacatacttttggtaaagggttcttcttctatatcgttcaattcgcaacggccttcattttagctgttgccgctaatactggtttctcagcattcccagtgttggcttataacttagcaaaagataaatatatgccacatatgtatatggatcgtggcgatcgtttgggttactcaaacgggattatcacattggcaatcggttcaatggcgttgatcttcatctttaacggtgacacatcacgtttgattccgttatacgccgttggggtgttcattccatttacgctttctcaatcagggatgttgcgtaagtggtgggttgaacggcctaagaattggtttggcaaatcaatcgctaactttgttggtgccttgatttcatttgccattttaattatcttattcgtttatcgtttacctgatatctggccattcttcatcatcatgccaattatgatctggattttctataagattcatgatcactataagaaggttgcacgtcaattacgagtaagtgccaacgaagctgtcttacatgattatgatggctcaaccgttattgtcttggtcagcaacgtgactcaagttacccgcggggcgcttgattacgcacaatcaatcggtgattacgtcattgcaatgcacgtgtcgacagatgaaaatccggaaaaagaacgtgaaattcaagctgaatttaaggctgatttcccgaacgtccgctttgtcgatgtgcattcatcataccgttcaattcaaaaaccaattgttcgttttgtggatattgttagcaagaatgcccaaaaacgaaacttcacgacaacggtcttggtaccacaatttgtgccaagaaaaccatggcaaaatattttgcataaccaatcaagtttacgcttaagaacagcttttgccagccgtgaaaacatcattatctcaacatacagttaccacttgaaacattagatgcgaatattatttattggtgacacagttggcacaatgggacaaaaaatggtgaacgagtatttaccacttttgaaacaacaatataaaccacaggttaccattatcaatggcgaaaacatcgctgatggcaagggaatgacacaaaaggattacaagaacttattgcaagccggtgcggatgccattacgatgggcaatcatacttggaacaaacgggatattttggacttcattgatgatgccaaaaagttagtgcgaccagctaattttcctaaggggacaccaggacaaggcatgacgatgattaacgtcaatcaggctaaattagccgtcattaacctacaaggccgtgcattgatgggtgaattgttggaagatccatttgcaatgttagatgacatggtggcccaagtcagcaaggaaaccaattgtatttttgtcgattttcatgccgaaacaacgagtgaaaaattggccttagcttggtatttagatggtcggatttcagcgttagttgggacgcatacgcatgtgcaaacaaatgatgcacgtgttttaccagacggaacggcagtgttgacagacgccgggatgacaggtccttataacgggattcttggtgtgaaacgcgaaaaaatcatttcacggtttatgacgcaacgcccagaacgatttgaactagtgacagaaggtcctggccaattgaatggctgtttaattgaaattgatgatcaaacgggtcatgccaaatcaatcaaacccatccatatttcaccagatcatccattcggatcacgcttttagatgctgcaaaaaacaaaagaaacgccaatgatggcccaatatcaaaaggttaaggatcaatatccagacgcctttttattttatagattgggtgatttttacgaattattcaatgatgatgctgttaaagcatcacaacttttagaattaacgctgacagcgcgtaataagaatgcagcagaccccattccgatgtgtggtgtgccccatcatgcagcgcaaaactacattgatattttagtggatcaaggttacaaggtcgccatttgtgagcagatggaagatcctaaaacggctaagggcatggtcaaacgcgaagttgtccaattagtaacacctgggaccgtgatggacgaaaaagccggtcacgctaaacaaaataattatttaacggcagtcgttgcacaaggcgatcaatttggctttgcctatacggatttatccacaggtgaaatgaaggttagccaaatcagtagtttagatgtgttattaaacgaaatgttgagtttacaaaccaaagaagtggttgtgaaccatgatgtcccaagcgaagtcgttcaagcctttgtccaacaacaaatcttggtttcttatcaagatgagggggccgatacggcagaggtcagttttgtttctcaaaatatctcacaaccactagcattagccgtcattaaacagttagttgtttatttagcaacgacgcaaaagcggcacttgggccatttacaacgcgcccaagcctatgaaccttctcaatacttgaagttggatcattcggctaagatgaacctcgaattaacggcttcattacgaactggccataagagtgggacgttattgtggctactggatgaaacaaagactgcgatgggtggtcgtttattaaaacaatggttggaacgaccattgttggatttaaaccagattaagaaccggcaaaaccaagtcgctagtttcttacagcactattttgaaaggacgaaccttcaagaagccctaaccaaggtttatgatttggaacgtctagcgggtcgcgttgcttttgggagcgttaatggtcgcgatttgattcaattaaaaacatccttagaacagattccaaagattaaagatgttttgacgggcattaacgaaacgcaggcttttgatcaagcgttaacgcgtttggatccagttgatgatgtgcggacgttaattgaaacagcgattaacccggattcaccgatttcagtgactgatggcgggattattcaagatggttacgacgaacaacttgatcaataccgcaatgcgatgtctaacggcaagcagtggttggcgcaattagaggcgcaagaacgagaagccacgggcattcataatttgaaaatcggctttaaccgcgtctttgggtattatatcgaagtcacgcgggctaacttgagttcattaccggaagggcggtatgaacgcaaacaaacgttaaccaacgccgaacgattcatcacaccggaactaaaagaaaaagaacaactgattttagaggcggaagaacgctcaaccgctttagaatacgaattgtttacccaagttcgggaacaagtgaagttacagattgaacggctccaaacattggctaaaggcgtagcggccctagatgtcttgcaaagttttgcggtcgtcagcgaaagctaccactatgtccaaccaacattaagaactgatagtcgcgaaattgatttagtcgatggccgtcatccggtggttgaaaaggtattgggacgccaaaaatatatccccaatgctgttcaaatgggcaaagaaacggatatgttattaattaccggacctaatatgtctggtaaaagtacctacatgcggcaattggccttaacggtcatcatggcgcaaatgggttgttttgtacctgccaagtcagcgaacttgcctgtatttgatcaaatttttacccgcattggcgcggcagatgatttgatttcaggacaaagtacgtttatggtagaaatgatggaagccaaccgtgcaattatgagtgcgaccgccaatagtttaattcttttcgatgaaattggtcggggaacggcaacttacgatggaatggccttggcacaagcgattatcgaatatatccatgatcacgtccacgccaagacgctcttttcaacgcattatcatgaattgacggctttagccgatacgttgaccgccctccgtaacgtgcatgttggtgcggttgaggaaaacggcgagttggtcttcttacacaagatgttggccggacctgcggataagtcttacgggattcatgtcgctaaactagcgggcatgccagaaaccttattacaacgggccgatgttattttaggtcagttagaagataaaccaaaagcaccggtgcaaccagaaatagtcgtaccagcacaaccgactgcagcggctgtcgaagaacagatggcgctttttgaaccagaagtggcggccccggtcgataagaaaacagataaagtggtagcggcaattaagaattttgatttgatgagcgccacaccactagaagccctcaatcaattatatgagtggcaaaagcaattaaataaacattaaatgatggggaaaattcatgaactgtcggaaattctaagtaatcaaattgcggcgggggaagtgattgaacgccctgcctcagtggtcaaggaattggttgaaaacgcgattgatgccaatagtacgcaagtcgatattgttgttgaacaggccggtttacagatgattcaagtgatcgataatggtgacgggattgaaccagaagatgtgccagtcgcctttaagcggcatgccaccagtaagattgcgactcggcaagatttgttcaagattcaatcgctagggtttcggggtgaagcgttagctagtatcgcgtccgtttccgatttaacgattgaaacggcaactgcggactctctaggaacctttgctcattttaagggtggtctgttagaggaacaaaaaacaaatccgattcgaccggggacggcgattacggtgcgggatttattctttaatacaccggcacgattgaaatacgtgaagacttttcaaaccgaattggcgaatatcgtcgatatcgtcaatcggctagcaatgagccatccacagattgctttcacgctaaccaatgatgaccatctacttttaaaaacggccggcaacaatgatttaaaacaaacgattgctggtatttatggcgtcaccatggccaagaaactcttagccgtgagtgcttcggatttagattttaaactaacgggctacgtgtcattgccggaattaacgcgggcaacgcgcaattatttgtcgattttaattaatggtcggtttattaaaaattaccaattgaataaggccattatcaagggctacggttctaaattgatggtcggacgctatccaatcgccgtcttagcgattgagatggatccgctattgattgatgtcaacgtgcatccaacaaaacaggaagtccgcttaagcaaagaaactgccttgatgaccttgattgaaggggcaatcaaagaaagactggcaaccgagaatttaattccagatgccatgcagaatttgaaacggaccaagacggtagatgttgatcagctccagatgaatttaaaccaaattacacaagaacgacggcacccaagcggtacggtgcgaccagtcagtccaatgccagccacaacggtcaaaccggtgacaccagaaattgcggaaaccgaaacgccgttagccgcaccaactgctaaagcgccggcgatgacaccggagcggcccttatttgagcaaccccaggcattggccgagtgggatcagaagtatgcgaccgaagcagttgggaagccatttggtgaccaagtggtagacgaaacggacgaaaacgatgaaaccgtagtcgaacccactgttcgttttccggagttacgctacattgggcaactgcacagtactttcttattagcggaaggcgaagatggcttttatatcttggatcaacacgctgcgcaagaacggattaagtacgagtattaccgagaaaaaattggggaagtcagcacctctgtgcaaaacttgttagtaccgcttgttttggaatatccgaatagtgatgcgctaaagattcaggaaaaaactgaactcttggcgtcagtcggaattcaattagaaaatttcgggcagaatagttttgtggtccacagtcacccaacttggattgaacagggacaagaggaaatgacgattcgtgggatgattgacgatgttttaaaagacggccgcattagtattgctcaattccgtgagaagacggcgattatgatgagctgtaagcaatcaatcaaggcacaccatcatttagatgatgcccaggccaaagcgcttttagccgatctagcgaagaccgagaatccgtttaattgtccccacggacgcccggttttgattcactacacgcaaaaagatttggaaaagatgtttaaacggattcaagaaccacatcatagttggcagggcgaataaatgtttattttagcatcgcaatcaccgcgcagacaggcactattaaagcgcgttgtaaatgactttgaggtacaaccagcacagattgatgaacacgaaacaccgctaacgacaccgggcgattatgtccaaactttagcgcaacgcaagggtgaagcagtcgcggttcaatatccaacggcgaccattctagcggcggatacagcgattagttttcaagggacgctttatggcaaacccaaggatcgtcaagatgcctatgaaatgctgcgccagttaagtggtcagacacaccaagtttatactggattgtggctgatgaaagacggtctggtgcaacaaaaggttgtccaaaccgacgttacattttggcatttaagcaccgccgagattgaacagtatttagatcagaatgaatatgcggacaaagctggtgcctatgggattcaaggcgcgggtgcgctattaattaataagattaatggtgacttttacaacgtggttggcttaccagtcagcaccgttgcaagaatgttgcaggattaaatgatgaatgtggcagttttttgtggggccagcagtggccgtcgcccggtttatacacaggccgccagcgatttaggccattggttagtcaaacgacaagatcaattaatttatggtgggagtcgggttggcttgatgggtacgattgccgataccgttttagaaaacggtggtcgggtaatcggtgtgatgcctgaattcttaaatcaacgagaaccagcgcatgctggcttaagcgatttggtgatggttgacaatatggccgaacggaaatcaaaaatgattgaattagccgatgtcttcatcgctttacccggtggaccaggtacgttagaagaaatgagcgaagtgatttcgtgggcgcgaattggccagcaagatggcccctgcattttctacaacgtagcgggttattatgatttattacaacaattcttagcccacatggttgaagaaggctttttaacacaaggcgattttgaaaaatacttgtttaccgattctttaactgaaatggcgacgtttattgtgacttatcaaccaccaaaaatacgagaatattaaatgtatgaatatttaaagggtttagtgacggcggttaatccgtattacgttgttttggaagtccaaggaattggctatcaattacaagttgccaacccatatcggtatacggaatcgatgagcgaagtggttcaaatttatgtccaccaagcagtacgcgatactgatattacgctttttggtttttacgacttagatgaaaaacaacttttccaaaaattaatcagtgtttccggaattggtcccaagagtgccttggcaattttggctaacagtgatcattctggcttaattcaggcgattatgaacgatgatattgggtacttaacgaagttcccaggcgtcgggaagaagacggcccaacagattaccttagatcttaaaggtaagttaggtgatctagaacaaagcgcaacgttagtcggccaaacggcaattgatttaggcagccaaggtgactcacctgaattaagtgatgcgctagcagctttgagtgcacttggctattccgcacgggaagtcaaagcgattacgcctaagttaactgattttgcagcgcaaacaactgatcaatatctcagagaaggtttgcggttattgatgaagaaataaatggcagatgagcgaattgtttcagccgaaaacgatgattttgctgaagcaagcattgaaaaaacattgcggccacaagtccttgcacaatatatcggtcaagatcgggttaaaaatgaattagcggtctatattgaagcggccaaaaaacgggaagagtccctcgatcacgttttactttatggcccaccaggtttggggaaaaccacgttagcgatggtgattgccaacgagttgcaagtccagattcgaacgacaagtggccccgcaatcgagcggcctggagatttagtggcgttattaaacgagttacaacctggggatgttttatttattgatgaaattcatcgcttacctaagatggttgaagaattactttattcagcgatggaagatttctacatcgatattgtggttggtcaagggcctaccgcacatcccgtccattttccattaccaccattcacattgattggcgcgacgacgcgggcgggcttattgtctgcgccattgcgagatcgtttcgggattgtggaacacatggcttattacacggaggctgatttgatggacattgtgcaacgctcagccggcgtctttaatatgtcgattgtgccagatggtgcgttagaaatcgcacgtcgctcgcgagggacgccgcggattgccaatcggttgttgaaacgaactcgagattacgcacaagtggctgaccaaaatacgattgatcaggcgattgctgatcacgcattaagtcagctgcaagttgatattcggggcttagacggtgtcgatcgcaaaatcctccagatgatgattgattattatcaaggcggaccagtcggtttaaaaaccattgccgccaatattggtgaagaaaacgaaacaattgaagaagtttacgagccttatttactgcaaattggctttttaaaacgaacgcaaagaggccggctggtaacgccggctggttatgcccatttaggcatgccttatccagaaaaatagatggtatccacagaagattttgattacaatttaccagaagaattaattgcacaaacaccaatgattgaaagagcagcatcacgtttattagtgatggatcacgaaactggtgctttagaagacaaggttttctacgatattattgacgaattaaaccctggcgatgcagttgtcatgaacaacacgcgtgttttaccagcacgtttatacggtgttaaacctgatactggtggtcatgaagaagtcttgttattaaacaatacgcatgacgatgaatgggaagttttaatgaagcctgctaaacgggctaaagtggggactgaagttgtctttggtgatggccaattaagagccattgtcactaaggaacttgaacatggcggtcggatgatcgaatttaaatacgacggcatcttcatgcaaattctagaagctttaggcgaaatgccattgccaccatacatcaaggaaaaattagatgatccagaaatgtatcaaacagtttatgctaaggaaccaggttcagccgctgcaccaacagccggtttccattggacagaagaacttttacaaaaggtgcaagataaaggcatcaaattggtttacttaacattgcacgttggtctagggactttccgccctgtttcagaagacaacgttgaagatcacaagatgcacagcgaattctatcgtttaacagaagaagctgctgcaacgttgaacgaagtcaaacaaaatggtggtcggattgtagcgactgggacaaccagcattcggacattagaaacaattgcaacgaagtttgatggcgaaatcaaagctgatagtggttggacagaaatcttcatcaaacctggttaccaatggaaagccgttgacgcttttatcacgaacttccatttaccaaaatcaaccttagtgatgttagtggcttcatttactggccgcgaaaacatcttaaacgcttatcaacatgctgttgatgaacgttatcgtttctttagctttggcgatgccatgtttgttaaataattgatgtatttaagaaaagccgctttttctgatttaccacgaatttcagcaattatcgatggtgctaaagccgcgttaaaagaacggggtgttaaccagtggcaagctggcgatcctagtgaaagtcagtttgaaaatgatattcgccaagaatattgttatatcttaattaaggatgatacgattgttggcgtcgcatcaattgtcgatacagttgatgacggctacagtgcaatcacgaatggtgactggcaatcggttgcttctaatcatccctattattcaattcaccggatagccttagatggttcagttcgcggccaacatttggcccatcagtttatgacgttattaattacggccgccagtattgacggcgcgcacgatgttagaatcgatacgcatcccgataatttagccatgcaacacgtcattcaaaaggcgggctttacttactgtggcgatatcttgattgctgatgatccgtcacctaaacgctttgcttaccaactcgttttaaaataaatgacaagtccaattcatgtaaattccgaaatcggaaaacttaagacggtcttactaaaacggccaggtaaagaagtcgaaaacattacacctgacattatgtatcgtttattgtttgatgatattccttatttaccaacaatccaaaaagaacacgatcaatttgcacaaacattacgtgacaatggtgttgaagtgctttacttagaaaacctcgctgccgaagcaatcgatgctggtgacgttaaggaagctttccttgataagatgttgaacgaatcacacatcaaatcaccacaagttcaagcagccttaaaagactacttaattagtatggcaacgttagacatggttgaaaaaatcatggctggggttcggaccaacgaaatcgatattaaatcaaaggcattgattgacgttagtgctgatgatgactatccattctatatggatccaatgcctaacctatacttcacacgcgatcctgccgcatcaatgggggatggcttaacaattaataaaatgacttttgaagctcgccaaagagaatcaatgttcatggaagtcatcatgcaacatcatcctcgttttgccaaccaaggcgcacaagtttggcgcgaccgcgatcacattgaccgcatggaaggcggcgacgaattaatcttgagcgataaagtgcttgcaattgggatttcacaacggacttccgcacaatcaattgaagaacttgccaaggtattattcgctaaccacagtggctttgaaaaaatcttagcaattaagattccacataatcatgccatgatgcatttagatacagtcttcaccatgattgattatgataagttcaccattcatccaggcatccaaggtgctggcggcatggttgacacttatatcttagaaccaggcaataacgatgaaatcaagattacacatcaaacagatcttgaaaaagttctccgcgatgctttggaagtgcctgaattaaccttaatcccatgtggtggcggcgatgcagttgttgcccctcgtgaacaatggaatgacggttctaacacattagcaatcgcacctggcgttgttgtcacttatgatcgcaactatgtttcaaacgaaaacttacgtcaatatggcattaaagtgatcgaagtcccatcaagtgaattatcacgcggtcgtgggggtccacgttgtatgagtatgccacttgtaagagaagacttaaaaaaataaatgacaaacagcgtatttcaaggcagaagtttattagcagaaaaagattttactaaatcagaactcgaatacttaatcgatttctcattacatttgaaggatttaaagaaaaaagggattccacatcactatctagaaggtaagaacattgccttactatttgaaaaaaattcaaccagaacgcgtgctgcttttacaacagctgccattgacctaggggctcacccagaattcttaggtaaaaatgatattcaacttggtaaaaaagaatcagttgaagatacagccaaagtattaggaagcatgtttgacggcattgaattccgtggctttagccaaaaagtggttgaagacttagctaaatattcaggtgttcctgtatggaatggtttaactgacgaatggcatccaacacaaatgatcgccgactttatgacagttaaagaaaacttcggcaaattaaaaggtgtgacattaacttatgttggtgatggccgtaacaacatggctaacagcttgttagtaacaggttcaatgttaggtgtaaatatccacatcgttgccccagattcattacaaccaacacaagaagtccgtgatttagctgaaggttacgctaaagaaacaggcagcaagaatatgattacttcagacgttgacgctggtgttaaaggctcagatgttttatacacagacgtttgggtttcaatgggtgaagaagataagtttgaagaacgggttaacttgttgaaaccataccaaatcaacatggacatggttaagaagaccggtaacgaaaacatgattatcatgcactgtttaccagctttccatgatattgaaactgaatatggtaagaagattgacgaacaattcggtattcaagaaatggaaattactgacgaagcattcagaagcaaatatgcccgtcaatttgaagaagctgaaaacagaatgcactcaatcaaagcaatcatggcagcaacattaggcaacttattcatacctcaagcataaatgacaaaacgtaaaatcgtcgttgcattaggtggcaatgctattttatcaactgatgcctcagcaaacgctcaaatcaaagccgttaaggaaacggttaaacaattagttgcattcgtaaaacaaggcgaccaactcattatttcgcatggtaatgggcctcaagtcggtaacttgttgattcaacaagctgctagcgattctgaaaagacaccagcaatgccattagatacggtcggtgcgatgtcacaaggcgaaattggttactggatgcaaaatgcttttaacgaagttttagcagaagaaggcttggctttagatgttgccacaatcgtaactcaaacgattgttgatgctaaagatgaagctttccaaaacccaacgaaaccaatcggacctttctatagcgaagcagaagctaagaaacaacaaagtatcaacccagaagcacactttgttgaagatgccggacgtggctggcggcgagtagtcccttcaccacggccaattggtattcaagaagcacccgttattcaaaaattagttgaaggtaacgtgatcacgatttcagccggcggcggtggtgtgccagttgcgaaagaaggcaacaagctccgcggggttgaagccgtaatcgataaagatttcgcttcagaaaaattagcggaattagtgggtgcagacatgttaattattttaacagctgtggataacgtctacgttaacttcaacaagccagatcaaaagaaattaaccaacgtctcagtcgctgaattagaagattacatcaaagacgatcaattcgctaaaggcagcatgttacctaagattcaagccgcaatcgaatacgttaataatcgtcctgatagtaaggccatcattacttcccttgataacgtgaagaatttattggcacatgatgccgggacaattattacgaaatagatggaaattgcaaatttcggcgttgaagagtggttaaacgtgtacgaaacacaagcgactttggatatcgcgcaaagtacgattgcctcaatgaccatgtcagaattgatggccctctcgcctgataacgggacacaattttatcaagacttagcgcaacaaaagatgaattatggtgcgattgagggttcagaggcctttaagcaagctgttagtgaattgtatcaaacggtcaacagtaatcaggtgttgcaaactaacggggcgaccggtgccaatttattagcgctctatgccttagtgaaaccgggcaatcacgtgattaccatgtttccgacttatcaacaactctacgaaattcccatctcaattggggcaaccgtttcgtattggcagttggatgaggccaataattgggtaccagatattgctgaactgaaaaagttaattagaccagaaaccaaattgatttgtttgaacaatgctaataatccaactgggacggtcatttcgactgaactgatgcaagcaatcgttgaagtggcacgaacggtgggcgcatacgtccttgtggatgaagtttatttaccattaggtgaaggccaacaaacaacttcgattgctgatttatatgaattgggcattgcgaccaatagtttatcgaagacctattcagtccctggtattcgggttggttggcttgtcgctaacgaaacattaaccgatttgtttagaaaatatcgtgattacaccatgatttgtgccggtgttttcagtgatcagttagcggtttatgtattacagaatcgcaagcaggttttagcccgtaatcgggcgcttgttcaacacaatcttgagatttttaaagcgtgggttgcacaagaaccactcgttgatgtggtctatccagaatcagtatcaacatcgtttattcatttcaaagagattgaagacgatgaagcattttgcaaatatttattaaaagaatacggcgtcttattagtgcccggcaagcgttttgaaattcccggacatgcaagattagggtattgtgcaccagaagcaactctgaaaaaagggttggccgaattatcaaaagcgctcagaacctattaaatgacggaagaaaaaccagcaaaaaaaattggcttattggcattaattgcattggttattagttcatctattggtagtggggtcttcggattaacatctgatttagcgagtgcatccgcaccgggcccagtgttaatcgcatgggtgattgtcggctttgggattttaatgctggcattatccttgaataatttattgatgaaagaacctgaactagaagggattttctcttacgctgaaaagggctttggcccctttgccggcttcattagtggctggggttattggttgtcagcatggttggggaacgtagcttttgcgacaattttaatgagtgcgttgggttatttcttcccgatttttaaatcagggcagaacttaccctcaatcttagttgccagtgttttatcgtggagcttaacatattttgttaatcgcggggtagaaggcgcagctgcgatcaatacattggtaacaatttgtaaattgattccactatttgtcttcattatttttgggattgtgttatttaaaggtcatcttttcacacaagcattttggaataatatgagtagtagctttgttgccggcgatgtgatgagccaaatcaagaactgtatgatggttatgatgtgggtctttgtcggtatcgaaggcgcttcaatgttatcggcgcgggcggaaaagaagtctgatgctggtaaagcaacaattttaggattagtgagtttactagccatttatatcttagcgtctgttttaccttatgggtatttaacgcaagatcaattagctagcatcaagcaaccagcgatgttatacatttttgaacagatggttgggacttgggggggctacttcatcggtgttgggttaatcatctcaattttaggggcttggttatcttggacaatgttacctgccgaaacaatgttgttaatggcaaagcaaaatttattgccagcttacttcggtcgcgtcaacaagaaaaaagcaccgacgtttgcactagtcgtgacagcggggttgattcaagttttcctattcaccctattattcacaacgaaagcttataacttcgcttattcattatgtacggcttcaattatcgtttgttacatgttggtggcagcttatcaaattaaatattcttgggcccacctgcaagaaaaaggaaatcggcaacaattattaattggggttttagccttattatttgaaattgccggaatcttaatggcgggtgtcagttacttattactctgttttatagcctatattccggggatttacttctatggtcgtgcccgtaaaaataatgggcaccaacatttcttatcaaaaggggaatggttaatcacgacaattattgtcatcggtgcaattatcgggatttggttagttgtttcagggaaaatcgttatttagatgattgccgcagacgaatatccaagatatattcaatacttaaggaccagacctgaatttattgatttttcagatgaagaaatgaatattctgatgaataatatgaaagtcaaagattttcataaaggccaggaattgtttgatcaaacagatgagcgcagccgattctatttcgttgtaagcggtctcgtaagagctgaacggacggatgaaagtgatgaatttacgttctatacgtatatcaagcaaaacttagcttttccttatcgggggatgtttactgatcaatattatccatacaccgctcgggcgatgacggatattgagattatttatttcccaatggcgacttttgagcatcttttacaaaagaataccgattcaattgttaaagtcgttcaagaaatgggctcgattattagtgaatcagaagatcagatccagcgaatggtaacttctagtgcgaaacaacgggttattcaagccctaaaaatatttgaaattaacttaggtgaaccgctacggtgcggccgctcatatattccgtatccaattacggtgaaggaattagcgacaatgagtgggactacccgtgaaacagcgggccaaattgttaaacaattggctgcccaaaaactgctgagttatgagcataaagaatttcggtttgaaaaagccttctttaaagatgacttggcgtaaatgaatgatgctgaaataatcaagactaagaagcggtttaaacttaaaatgccgggggcttttgtgatcctcttcatactgacagtggtcgcggtgatggcgacgtgggttgtgccgtcaggatcttacgcgaagttatcgtatgaccaaaagagtacgcaactggtcgtgacaaaaccatcaggtcaagttgaaaaggtgccagcaacacaggcatcattagaccgactcggcgttaaaatcaaaattagtcaatttacttctggcagtattaatgcagccgtatcgattcccaatacctaccaaagattgaaacaacggccggccagtttagcagctgttcctaacagtatggttcgtgggaccgttgaagctgtcgatattatggtttttattttagtattagggggcttgattggcacggtcaaggctagcggcgcatttgagtcggggctgttggccttaaccaagaaaacaaaaggtcacgaatttttgttaatctttttcgtcgcgattctcatggttctaggcgggactttatgtgggattgaagaagaggcggtggccttttatccaattttagtaccggtctttattgcgatggggtacgattcgattgtttgtgtgggggcgattttccttgccagttcaattggcacgactttctcgacgattaatcccttttcagtcgtgattgcttctaacgccgcgggtattagtttcacggaaggcttgttgtggcgagttggtggctgtatcgtaggggccatttttgtcatttattatctctatcgctattctaaaaaggtcaaggctgatccgacccaatcgtattcatatgaagatcacgatgcttttgataagatgtgggcaattacatctgaggggacgcagtcaaaagccgtttttacctggcggaagaaattaattctggtcttatttgtggtgaccttcccgattatggtctggggcgttatgtctcaagggtggtggttcccaacgatggcggcgtcatttttaacgtttgcgattatcatcatgtttttaaccgcgacaggaccagaaggcattggcgaaaaaggggttatcgacgcttttgtgaacggtgcttctagtttagtgggcgtctcgctcattattggtcttgcgcgagggattaacttgattatgaatgaagggatgatttcagataccttattacaatattcgtcatcattagtcgcacatgttagtggtccgatttttattttgatcatgttagtgatattcttcgtgcttggctttatcgttccatcttcttcgggactagccgtcttatcgatgccgattttagcaccgttagcagatacggttaatattccccaatttgttgtggtaacggcctatcaatttgggcaatacgcaatgttgttcttggcaccaactggcttggtaatggccaccttacaaatgttagatgttaaatacgctcactggttacgattcgtttggccagtagtcgcttttgtgctgacttttggtggggccatgttagtcttacaagtcctaatttattcgtaaatggaaccagcgatcaagtatcgtttaatcaaaaaagaaaaacatacaggcgcgcgcttaggcgaaattgtaacaccgcacgggacttttaaaacaccgatgtttatgccggtggggacccaagccagcgttaaaacaatggcccctgaagatttgaaagaaatgggtgccggcattattttgtcgaatacttatcatctatggttacgccctggtgaagatatcgtcgaaaaagcaggcggtttgcataaattcatgaactgggatcggggtgtcttaaccgattcaggtggtttccaagtcttctcattagcgaaattacgtgatattagtgaagaaggggtggccttcaagagtcatttgaacggtgaaaaactattcctatcacctgaaaaagcaattcatgttgaaaatgctttgggcgcagatattatgatgagttttgatgaatgcccaccattcttcgaaagctatgactacgttaaaaaatcagttgaacggacttcacgttgggctgaacgaggcttaatcgcgcatcaaaatcctgccacacaaggcttatttgggattgtccaaggggctggttttgaagacttacgtcgccaaagtgcacgtgatttagtggggatggatttccctggctattctatcggtggtctttcagttggtgaatcaaaaggtgaaatgaaccgggttcttgattttacaacaccgatgttgcctgaagacaaaccacgttatttgatgggcgttggctcaccagatgcgttgattgatggtgtcattcggggtgtcgatatgtttgattgcgtgttaccaactcggattgcgcgtaacggaacaacgatgacgtctcaaggccgtttagtggttaagaacgcgaaatattctgaagatttcagaccactagatccaaaatgtgactgttatgtctgcaagaattacacacgggcttacatccgtcatttaatcaaagcggatgaaacttttgggattcatttaacgagttaccataacttatacttcttgatcaacttgatgcaccaagtgcaagatgcgattgaacaagataacttattggaattcagagaagcattcttcgaagaatacggctataacgaaaataacggccgtaatttctagatgttaaacctagtattaggtgccaatccatttggcggcaattcaagtttcttgatcatccttgttttgatgatggtcatgatgtatttcatggttatgcggccacaaaagaaacaacaacaaaaacatcaagaaatggttaaccaaatgaaaaaaggtgaccaagtcgtaacaattggtggtttacacggtgttattgactcagtgaataacgatactaaaattgttgttttagattgcgatggcgtttaccttaagtttaacttaagtgctatccggacagttgaaccaactgctaaggcaacagaaacagttgttgaagaaacggttgacgaaacaaaagaagaaacaaaatagatggttaaaaaagaaggcgttaaagcggttgttgatgcggtatctgaagtggataagatggtgacggatttagtcacacgggcccatgaagcacttaaaatcatggagacattcgatcaagcaaaggtggatcatattgtccaccaaatggcgattgccggccttgatcatcatatggaattagctaaaatggccgttgaagaaacgggtcgtgggatttatgaagataaagccattaaaaatattttcgcaacggaagaaatttggcacgcgattaaagataataaaacagttggtgtcattgaagaagatcctgaacatgggattactaagattgcggaaccagtcggggtcattgctggggtaacacctgttaccaacccaacttcaaccacaatttttaaggcagagattgccattaaaacacggaatccaatcatctttgcttttcatcccaatgctcaaaaatgttctgccagagcactagaagtcattaaagaagaagccgttaaagctggcttaccagctgacgcgttattattcattgaagaacctagtttggcagccacccaagctttgatgaatcataccggcattgcaacggtcctagcaactggtggaccagggatggtcaaggctgcttattcaactgggaaaccagcattaggggttggggctggtaacgcaccagcttatatcgaagaatcagccaatatcaaacaagcagtcaatgatttaattctatcgaaatcatttgataacgggatgatctgcgcatcagaacaagcggtgattgtcgatgctaaaatctacaacgaagttaaaaaagaattccaagcacaaggtgtctattttgctaaagcaagtgaattaccagctttaaacgaagcgattattgatccggctaaaaacgctgtacgaccagcaattcctgggcaatcagctgctaatattgctaagttagctgggattgatattccagaagatacacccgttttaattgctgaaatcaagggtgttggtcatcaatacccactctcacatgaaaaattatcaccggtcttagcgatgattaaagctaaagaccgtgaagatggtttggcattatgcgaagcgatgcttgatctgggtggtttgggccatacagcatcattgcatacgactgacgatgcgttaccattagaatttgcaagacggatgaaggcttgtcgtgtattggtcaatacaccatctgcccaaggtgggattggtgatttatacaacgaaatgattccatcattaacacttggctgtggctcttatgggcataactcaatttcacataacgtgtcaacaatcgacttattgaatattaaaacattggcgaaacgtcgcaataatatgcaatgggtcaaattgccaagcaaaatctattttgaaaaaaattcggtcaactatttagaaaagatggctgatttaaataaggtttttatcgttgctgatcaggggatggttaaccttggttatgtccggattgttgaagaagtgttagctaaacgggcgaatgacgttcaaatgcaaatcttctcagatgttgaaccagatccatcaaccaacacgatttataagggtgctgcagcgatgcggagttttgaaccagatgcaatcgtcgcaattggtggcggttctgtcatggatgctgctaaagggatgtggttattctatgattcagaagaagccgacttctttggcgcaaaacaaaaattcttagacattcgcaaacggacttacaagttccctaaacttaacaaaacgaagttaatctgtattccaacgacttctgggacgggttcagaagtaacaccttttgcggtgattactgatagtgaaacccatattaaatacccgttggcagattatgcattgacaccagacgttgcgattgttgacagtcaatttgtcgagagtgtgccaccacgagttgttgcacacactgggttggatgtgctctgtcatgcgactgaaagttacgtatcaacaatggcttctaactacacgaaggggcttagtttacaggcgattaaattagtttttgataacttgaaggctagttacgatggcgatattacggccaaaggtaacatgcacgatgcctcaacaatggcggggatggcctttgcgaatgcgttattaggcatcaaccattcactggcacataaattaggcggggcattcaacttacctcacggtttaatgattgccatcacgatgccgcatgttatccgctataatgcgacaacgccaaccaaacgggcactctgggctaaatatagttacttcagagctgatgaagattacgccgaaatcgcacgctatattgggttgaagggtaatacgacagcagaacttgttgaagcttatgcaaatgcagtgactgaattggccgaaagtgttggcattcaaatgagtttgaaagctaatggcgtcacaaaggcggacttcaagcaacatgtggatgagttagctgaattagcttatgaagacaactgtactgttacaaatccaaaagaaccattgattaaagaattaaaaggcattttagaggcagaattttaaatggcaatgacacccaataaagaagactatttaaaaattatttttgaacttggtggcgacgcaaaaaaagttaccaataaggaaattctagcgggattgaacgtttcggcagcatcagtcacggaaatggtcaacaaattagtgaaagagaattacgtcaaccacacaccctatcaagggattcaattgacaagtgaaggtgctagagaagcagcgctattagtgcgcaatcatcgcttgtgggaagtttttctagtcgacaagttacattatcaatttaataccgttcatccagaggcggagcaactcgaacatgtgaccaaccacgacttggctgaacgcttagccgattttctaggtcatcccaaacgatgcccgcacggtgggattattcccaatgccaaaggtgagtttgaacaacagagccatcacgcgttagtcgaccttgaagttggcgaaaaagcagtgattgaacgggtactagatgataatgatttattgaaatacacattagaaatcggcttgacagttggcgatactgtgaccttgacgaaggtgggcctttttgaaagccccattaccgtgatggacgaaacacagcaaactgaaattcaagttggcattaaagcggcgcaacacatttttgtgacgccaattgcagcagattaaatgcgctcagatttagcagcattatttattatatttggtggctcgggagatttagcacaacggaagttatacccagccctttttaacctatatcgtaaggggtacttaaaagaaagcttcgcagtgattggcaccgctagacgaccttggacggatgaacattaccacgaaatcgtgatggcctctctagaaggttttgaagaagatgatgaaacgaaacagacttttactagtcacttctattatcaatcgcatgacgttacggatgctgaacattatgaaacactgaaggcattagcagcaaaattagatgacaagtaccaattaaaccaaaaccgcatctattatatggcaatgtcaccccgttatttcgggacaattgccagtcatttagggtcagaagctttattgaccgcagatgggttcaaccgtttaattattgaaaaaccatttggtcgtgattatgaaagtgccaaagcactcaatcaagaattaactcaaacttttgatgaaaaccaaatttatcgaattgatcattatttaggtaaggaaatgattcaaaacatcgttgctttacgtttcggtaatggtctattgagtggtgtttggaataatcaattcatcgataacgtgcaaattacgttagctgaatcggttggggttgaagaacgggctggctattacgaaacatctggtgctttgcgcgatatgttccaaaaccatatcatgcaagtcattgggatgttggcaatggaagtcccagttaacttctcagcagaagatgtgcaacgcgaaaagacacgtctgttcagaagtatccaaccttattcaccagcagagattaaacaaaactttgtccgtgcgcaatacgctgaaacaacggtcgatggtgaaaacaaaccgggttatcgccaagaaactaacgtggcaccagattcacaaaccgaaacgtttgttgccggtaaagtgatgattgataacgaacgttggtgtggcgtgccattttatgttcggaccgggaaacgcttggcgcgcaaggaaacccaaatcaacatcgttttcaagaagaccggggttaatatttttgctgatgataaatcagatcgctcagcaatggcaccagatgtcttaaccatctatgtggaaccagaacaaggcttctcattaacaattaatggtaaggaagtcggtcaaggtttctcattgaaacccgaccaattgaattatcaatacgacaaacaaatgttagctgacagtccagaagcttatgaacgtttgattttagaagcgttaaatggcgatggcacaaactttacgcattggcatgaattggctgcttcatggcaatttgtcgatgcgattcgccaagtttgggatgcagatcaaacaccgcttcctacgtatgcaatcggttcgatgggccctaaagaagcgacggatttattggcttcaacggatgccaaatggatttttgatccaactcaaacaaaaaaataaatgactgaattatttaaaattccgttggaaaatgatacaagtcgcaagattattcatattgatatggatgctttttacgcctccattgaagaacgtgagcagcccgacttacgccaaaagccgttgattattgcccgtgatccgagtgatacggggggcaaaggggtcgtgacaacggccaattacgttgctcgccaatacggtgtgcattcggcgatgagtgcccaaaaggctgccgaattaattcctaaacaccaagccgtttttaagacgccaaactttccgctgtatcagtccgtttcggcacagattcacgatatttttcatacggtgaccgataagattgaaccgattgcctttgatgaagcttatttagacgttactgaaaataagttgggattaacgcacacgattgaagtggtcgcttacttgcaaaaggcgattttagaagaaacgcaattggtcagttccgccggaatttcctacaacaaatttttagcgaagatggcttctgattaccgtaaaccggctggtcgaacactggttttgccggaacaagcaatcgcctttttaagccgattgccgattgaaaaatttagaggggttggtcaaaagacggtgccgaagatgcaggatttaggcattatgaccggtgctgatttattggcgcaatcggaaatgtttttgatgcaacattttggcaagttgggttatgggttatatcgccatgtgcgggggattgataaccggccagtcgaataccaacgagaacgtaaatcaatcggtaacgaacatacttacggacaaccgttgattagcgaagaacaagtgcaggcccaactgaaaagcttggcggttgaattggcacaacggctgcgcaaaaatcaaaaacacgggttaacagtcgttttaaaagtgcgtaatcggcaatacgaaacaattaccaaacgcaaaacacttggcgaatatgtcgggaatgcagctgaattagaggcaattgccaaccaaatttggcaatcaatcgggcaggcggaagttggaattcgcttgttagggattaccgtgaccaatttagcaccccagacttttgaaaatataacgctcccactttatgattgggaaaatgattgagtggcaacgaagcatgatcaaatattaatgtacattgagaatttgccaattggcgataaaatttcggtgcgctcaattgccaagacgctagcggttagtgaagggacggcttatcgggcaattaaggccgccgaaaataacggcttggtcagcacgattgaacgggtcggtacgattcgaattgaacaaaaattaaaaggtaagattgaaaacctgacttttgccgagattgttcaagttatcgatggtgaagttttaggtggcaaagatggcttgaataaattgttggataagttcgtaattggtgcgatgcagttagcagccattacacggtacatcacgccgaaatcattattgattgttggtgatcgaatcgatgtgcaacgattagcgttggaaaatggcgcggcggttttaatcacgggtggctttcacacctcagatgaagtgattgcgcttgctaacgagctagcattgcccatcttgcaaacgacttacgatacgtataccgttgcgacgttgattaaccgggcattaaccgaccaattaatcaaaaaggaaattacgacggtcgcttcaatctatcgcccattttcagaaacatactcattattggcgactgatacggttggcgattacaagaaattgagtgccgcggttaaacattcacgcttccctgtgattaatgaacaccggcgcttagtcgggattgtcacggtgaaggatattttggataaaccagcttcgatgacgcttgataaggtgatgactaaagaacctgcgagtgttaagaagtatatgagtattgccagtgtcggacatgcgatgacttggaatagtttggaaatcatgccggtggttgctgataatcttgaattagaggggattatcacgcgtcaagacgtgatgagtaatatgcaaacggcccaacgacaaccgcaagtggccgaaactttctacgaccaaattatcgaactactgcaccctagcgagagcttccccgaattttattcggcggcataccagtttgaagtgagcccgcaaatgaccaataacttagggacgatttcgtttggtgtcttgagtgaagccgtttcggccgcttgtcagcgtatgttgcaggcgacacatcaacgccattcaatgattgaacagattaatttgcattatctgcgcttaatccaaattgaaagtcagattcagattttaccgcggatattagagattggccggcgttccgctaaaattgatgtcgatgtttatgccaatcacgtcattgttgccaaagcaattgtgacctgtcaaattttagaaagaggttaaatgactattccagaacaaattattactaaaattaaagcttatcaaacgattattattcatcgccatgtcaatccagatccagatgcgattggttcgcaagttggtttggctgaagtgattcgtaatagctaccctgataaaaaggtttaccaagtcggtagtgataccggcaacttagcttggttagccaatgcacaaccaattgatccggctttatatcaaggcgctttggtgattacaactgatgctgccaacacaccccggattagtggcgaagattataaccaaggggattacttgattaagattgaccatcatcctaacgatgagccctatggtgatttaaattgggtgttaccggatgcgtctagcacatccgaaattattgtcgatatgatcaatgatagccaaggccaattacaattgaatcaagcagccgctcgtgtgctttacgccgggattgtgggcgatactgggcggttcatgtttaattcaacgacgccccacacaatgacttgtgccgcgcaactaatgacgtttgacattcaacatgataagattaaccaacggatgaacgagattacactcgaacaagcgaagttacaaggttatttatttgatcaattgcaggttaatgacgaccaagtggcttatctggttgtggaccaagaaacgcaaaaacgtttgaatgtatcagcacaacaggttcattcaattgtcggcacacctggccgattaaaaggtgtgttaacatgggtcatttttgtccaacaagacgatggtacttatcgcgtccacttccgttctaaagggccaatcattaatgaattggctaagcaacatgacggcggtgggcatccgcttgccagcggggccaaagcagctgatcaagctgaaattgacacgattattacggcattatcagcgcttgctgctgattacacagcacagtaaatggataatcaatttacacaatttaatctaaaaccagaaatcattgcggctttagacgagatgcactttacaaaaccaacggcggttcaacgccgtgtgattccagccatcaacgctggtaagagtgttatcggacaatcacaaacagggagtgggaagacacatgccttcttattaccacttttaaataagttagtccctgaaaaagacgaagttcaaatcgtcatcacagcccctagtcgggaattggcttaccaaatttatacggccgctgaattaatcacaaagcatatgactggtgatattcggattggtcgctacgttggtgggactgataaacaacgtcaaatcgaaaaattacaacaacatcaaccacaaatcgtgattgggacacctggtcggattttagatttgattacaagtaaggcacttaagatttatacagctaaaacattagtcattgatgaagctgatatgacgcttgatatgggttttttgaagccagttgataatattgcgagccgtttacccgaagacttacaaatgatggtcttctcagcaacgattcctgataaattacaaccgttcttacaaaaatatatgcataacccagtaattgaagaagtgaaaaatgaaacgatcatcagcccaacgattgaaaactggttggtgccaactaagggcaaagccctcaatcaaacaatctattcattaatcacaatgggccatccattcatggtcttgatctttgccaataccaagagcaaggttgatgacatccatcattacctccaatcacaaggtttgaaggtcgctaagattcatggcgatattccaccacgtcaacggaaacggattatgaaggaagtccataacctcgattatcaatacgttgttgcgactgatttagccgctcgtgggattgatatcgaagggattagcatggtcatcaatgccgaagtgccacgcgaagatttagaattcttcgtgcatcgtgttggtcggacaggtcggaacggccttaagggtactgcaattacactttatggtccagatgacgaacaagctgttgcacaaatcgaagcaatgggaattaagttcacaccaaaagcctttaaagatggcgaattggtgacttcttatgaccgtaaccgtcgtaaaaaacgggttgcaacgactcatgaattagacgttaacttgaagggctttgttaaaaaagccaaaatcaagcgtaagcctggttacaagaaaaagattaaagaagcaatccaaaaggatgcgcgtcaaaaacgtcggattgaacaacgggttgaaatgcgtgaacgtaaacggaataataaaaaacaaaatcaaaaataaatggtacatgaaaatgacttgcaattaccaaattggttacaattatcggaacaagcccggcgtgctaattttggccaggttttacggtattttgtcagcccccttgtcgccattgaagggattcaaccggaagtggtgcaggctggtcgactaacatttaagacatatagtgcttggttttctggtgaacagttcgtcttcgttccggcacaatcagccgttagtttaggttggtcattgggtgcggataagctggcacctagtgaatggtttgcacaaaccaatcggcaactggctgccaacgaaggacaactctgggcagataaggctgatgtggatgcgtatgttgagcaactcaccacgccgagtcggattgttaatatgccagcgttactggtggcgcgagaatccgtaccacgtgattggctagcgcaaggacgctattcaccaatcacacggcattttacaggcaaccaactgttcttcagtcgttttcaagctgagattcaaaatggactataccgaacgcagcctgagacaccgttgttagaaacggcgcacttagtgttacggcttttggcagaccaacaagtttatcaggtttttgagaaaacgacttttacggatcaacaactcagacaaacattgcggcaacaaggctatgactttgtcagtgttgatcagtacgaatggttaagaggtgcgggtgcgcctactttatggccaagtggcaatcatttaccacaaccaatggctgaatcagcggcttcgtttggtttagattttacggctgaccaacaggcttatgaaataacaactgacccgcttgtttacaagggtgggccgtgtgtcactggtggtcgctatcaacttgaacgtcagttaccaagctcgccattttatgaatcaggcgtaccaactgcgttgatgggcaataccgatcttgcgacgcgttatcggcgcacaatcactgttgcactcgagtagatgaaacaactcacaagcgcccaagtgcgccaaatgtttttagacttttttaaagaaaaaggccatgatgttgaaccaagtgcctcattgattccagacgaagatccaacgttattatggattaactctggggttgccactttgaagaaatattttgatggccgtgttgtgcctaataatccgcggattacaaatgcacaaaagagtatccggacaaacgatatcgaaaacgttggtaagactgcccgtcatcatacattcttcgaaatgctcggtaacttctctgttggtgattactttaaagaagatgctattccttgggcttgggaattcttaacaagcgacaagtggattggtttagatcctgaaaaactttatgtgacggtttatcctaaggataaggatgcgcaccgcatctggcacgaaaaagttggtttagcagaagaccgaattatcgaagttgaagataatttctgggatatcggtgaaggcccatgtggtcccgattcagaaattttctacgatcgtggtcaaagcttcaacaatgtaagtgaagacgatcctgaaaactaccctggcggcgaaaatgaacgttatctcgaagtttggaatatcgtgttctcagaatttaatcacttaccaaacggtgaatatgtcgaacaaccacacaaaaatattgatacggggatgggtcttgaacgacttgtctcagtgattcaagaagccccaactaactttgaaacagatttatttatgccattgattgaagccacagctgcaatgagtgaccataaacaatacggtcaaaatgccgctgacgatatttcatttaagattatcgccgatcatgcacgggcagttacctttgcgattggcgatggcgcaatgccagctaacgaaggacgcggttatgtgctccgtcgtttaatccgtcgggccatcttaaacggtaagaagttaggcatcaacgacgctttcatgtacaaattagtcccaatcgttggcgaaattatgcacagctattacccagatgtcctagaacaaaaagacttcattgaaaaagtgatccgttctgaagaagatcgtttccgcgaaactttaaatgatgggttacgcttattaaaccaaacaatcgaagccgttaaagctgaaaacgaaactgaaattaacggcgcagatgctttcaaactctttgatacatttggtttcccaatcgaattaacaactgaatatgctgaagatgaaggtttaaccgttgatcaagctggttttgaaaaggaaatggctgctcaaaaagcacgtgctcgtaatgcacggagcgatgaacaatcaatgggctcacaaaacgaagtcttattaaacatcaagactaagagtgaattcacaggttacagcgaattagaaactgaaagtcgtctagcagatatcattcaagataatgctgaacaagaaagtgtgacaaccggcgttgcgcaattagtctttgaagcaacaccgttttacgctgaaatggggggccaagtggctgatcaagggattatcaagaaccttgccggtcaagtggttgctgaagtgacagacgttcaatacgcaccaaatggccaacctttacacactgttaaagtgttaaaagaaatgatcagtggcgtccactataccttatctgttgatccaactttcagaggcggcgttgttaagaaccatacggcaacccatttattggatcaagcattaagagatgtgttaggcgaacatactcatcaagctggttcattagtggaacctgattacttacgttttgatttcactaacctgggccaagtgacaccagaccaattagctgaagtggaacaaatcgtaaacgataagatttgggcagctcttccagttaatacggttgaaaccgatattgaaacagctaaacaaatgggggccatcgcgctctttactgaaaaatatggtaaaacagttcgtgttgttcaaattggggattactcaatggaactttgtggtgggacacatgctaataacacttcagatcttggcttgttcaagattaccagtgaatcaggtattggggctggcacacgtcggattgaagccgttacttctaaggcagcctttaaatatttaaatgacaaacaagtgcttttaaatgaattagctggtgaattaaaagttgcacaaacaaaggatcttcctaagaagattcaacaattacaagctgatttaaaagcagaacaaaaagaaaatgaacaattaaaagctaaatttgcgcaagaacaagccggcaatgtttttgaaaatgttgttgatgcaggtcaatggcgcttagtggcagcagatgcaaaggttgccgggatgaatgaattacggcaattagcggataaatggcaacaaaaacaaatttcagacgtcttagtgctcgcaactgttgcgggtgacaaggttagtttgattgtggcagtagctcctgatgcgattaaagctgggatcaaagctggtgacttaatcaaacaaatcgccccacttgttggtggtggcggtggtggccgtcctgatatggcccaagctggtggtaaaaatccagctgggattccagatgctttggcagctgctaaagaattcttagcttaaatgaatctagataaaacagtccattttgattttggtaagaatagtcctaagaatgtgcatgaaacattggtaacggtctaccaaactttagaagataagggctataatccaattaaccagattgtcggctacctgctatcaggggatcctgcttacattccacgctataacgacgctcgtaacttaattcgtaagcacgaacgagatgagattatcgaagaactcgtgaagaactatcttgataaggggaatactaaataaatgcgcttaatgggatttgatgtcggttcaagaaccgtcggtattgctgtgagcgatttatttggttggaccgcccaaggtgttgaaatcattagaattaatgaagatgaatctgaatttggtttagaccgagtgaaggaactcgttgcacagcaccaagtaacgggctttgtcttggggttacctaagaatatgaataattcaatcggcccccgggcggttaaagcacaggaatacggtgccatgttaaccgagttattcccagagatcccagttgattatattgatgaacgactaacaactgttcaggctgaacggatgttagttgaacaagctgacacctcacggaaaaagcgtaagcaagtgattgataaacttgctgcggtaatgattttgcagaattatttggatgctaagggccctttgacgaaacaagggtattaaatgactgaaacaaataagaacatccaccaagaagcagaacaagaaattactttaatcgatgatcaaggtaacgaagaattataccaagtgctctttacttttgattctgaagattacggtaaatcatatgtcctattatacccagcaagctcagctgaagacgaagaagtcgacatccaagcttttgcattcacatcagacgttgcaggagacgccagccaaggcgatctcttcccaatcgaagatgatgaagaatgggaaatggtagaagaagtcctaaacacattcttagcagacgacaatatgcaataattatgagcgtaaagcctgtgcttttttggtgttaataaaatgcaatttagcaaattggcctaggtattctaaaccgccttggtccaataaatcagccgcaattttgtcgatcgatttgtgtgcaccgactgggatgtcgcgtccagcgagtttggaaagttcaatcattgataggttagcttgatggcgggcaataatagaagctgccgcaaccgctagatgaaactgttccgctttagttgtaaagtagacgttatctcgtaataccaccggttcgtcttttaaataacgatagtaggtggcacgaggttcgaattgatcgattaaaatgccttggggctgatcaggttggatttttttcaaaacttttaagagggcgaagttatggctgaccgccttcattttttcgatattcatttgttcgtgaacttggttatacttttgcggcatgatattgacgatatgataagggagtttggtcatcattttaatcgccatctgatcaatctgagcgtcagttaatgtttttgaatcagcgacgcctaaattgcggacaaagctgagattttcctgactgacatagacggcggcaatcgtcagtgggccaaagtaactgccattaccaacttcatctgagccgataaccgaccagttagcaaaatcgggtggtagcgtgtcacctttagcagaccccttagtagccttacttttcttggcaggtgctagtgggccccatttagcagcggctgcttcggctgttgcgccttgaaaaaggactttgccggagcgatagccggtaacgttcaaaccgttgccacggtgggcaaaaacggcaccaggtggtaggggacggttggacggataagtttgttgaattgtttttaattgcgctggggtcatttttatcacagcttgcatatgctaagtctaattattatcttaatgttgttacatgcggtttatactgggatgcgccggggaattgtcttacaggtcgtttatgcaattggttattttatcgccttttggattgcggttccattgagtcagacactcggacctaaattgaatttgttagtgccgtatccatcggcaacagaagaaagttactttgcctttttccaacagaaggtggggttatcactcgataaagctttttatatcggtgtggcctttgtattagtgatgttcatcagtggcctgattattcgttttattggcttattactgaactcgttaacgtttatgtatgttttcagtcgatttaataaggttttaggtggtgttttaaacttcatcgttgtctatattgggattttcttagtgttatatgtcttggccttagtaccagttgacgggttacagaacatgttggcccattcgtggctcgctaagatgatggtgcttaaaacaccactattaacctcacttgtaacgcaatggtggatagttggttaaatgaatcataaaatattaaaaacattagagtacgataaaattaaacaaatgttgcaaggctatgcgattacagcatttggtcaagaacaaatagcaactttagaaccgattaatgaagcagatctgattcagattcgcttaaaccaaaccaaagatggtgttgatatcgaacggttaaaaggtggcattccattgccccaactggaaaatatcagaccacatttaaaacgaattgaaatcggtgcgatgttaaatggtagtgagctcgctcaaatcgggcgcgttttacgtgcgacatctgccgtggttcgtttctttgatgacctggaaaaagacgaactcgaattaaaagccttacccgaattagtagcgcaatttgtcacgttaccgcaattaaccgaacgaattagaagttcggtggctgatgatggtgccattttagatactgcttcaaccaagttacgcggtttaagaacgggcttgaagcagttagaaggccagattagaagtcggatggccagctacacacacggtgccaaggctaaatatttaagtgatccgatcgtgacgattcgtaacgaccgctacgtgattcctgttaaacaagaataccgcggccaattcggtggtgtggtacatgatcaaagtgccagtgggcaaaccctattcatggaaccccaagcgattatggaattaaataaccgtttgcgccaattacaaattgaagaacaacaagaaatcgaacggattttggcggaattatcagaagccatcatgccggaacgtcacaatattttagcgaatgctgaattattgggtcaacttgatttcgtgaatgctaaggcccaacttgcgaaagctctaaaagcaacggaacctttaatcaatgcggaaaaccatgtcgatttaaaacaggcacggcatcctttaattgatgcgactaaagtcgtggccaatgatattgcaatcggtgcggattatcaagcgattgtggtaactggtccgaataccggtggtaaaaccatcacacttaaaacgttgggcttagtccaagtgatggcccaatcagggttattcattactgcgcgtgaagaaagccaagttggtgtcttctcagatatctttgctgatattggtgacgaacaatcaatcgaacaaaacttgagtactttctcagcacacatggaaaatatcattcagattctcaaacagattgatgatcggagtttggtgctattagatgaattaggtgccgggactgatccgcaagaaggggccgctttagcgattgccatcttggatcaaatcgggattgtcggagccaacgtggttgcgtcaactcattatcctgaattgaagatttatggctacaatcgaccacaaacaattaatgccagcatggaatttgatgtggcgactttacagccaacgtaccgtcttttaattggggtgcctggtcggagtaatgcgtttgatatttcaacgcgcctaggcttaccaaattcaatcgtcgatcaagcgaaacagttaatgaacgatgaaagccaagatttgaacaatatgattaccgatcttgaaaatcaacgtaaagcggctgaaacagaataccaagcactacggcatgaattgacggaagcgacggatctacatcaacaactctcaacagcttatcaacaattctttgaagatcgtgaaacggaaatggcgaaggctaaggaaaaagcgaatgcgattgtcgaaaaagctgaagtcaaagcggataaagtcatcactaaattacgtgatatgcagatgaatcaaggcgcacggattaaggaaaatcaattaatcgatgccaaggctgaattagggcaattacatcaagaaacaaccttgaagaaaaataaggtcctccaacgggctaagcggcgtcaaacgcttaaagttggggatgacgtcttggtcacgtcttacggccaacgaggcactttaattcgccaagtcgattcgaaaaattgggaagtccaaatgggcatcatcaagatgaagattgctaatgacgatttagaaaagcaaaaagtcgttgaagataaccgaccacaacgccatgtgacaaccgttaatagcggtggcgcacgccacgttaaagcacaattggatttacgaggcaaacgctatgaagaagcaatggccgaagtggatcaatacattgatgcggcgctattagctaattatcaacaagtcacgattgtccatggtaaagggactggcgcgattcgccaaggggttcaagaatacctccaagctaaccgtcaagtgaagaagtacgaatatgcaccagctaatgctggtggtaatggtgcaaccattgtgacatttaagtaaatggtagatgttttaacggataaagattttgaagcagaaacaagccaaggtgttgttttaacagacttttgggctacttggtgtggtccttgtcggatgcaatcacctgtcattgaagagttagcacaaacaaatgataaggttaaattcacaaagatggatgtggatgccaaccctgataccccagctaaatttgggatcatggctattccaacattgctcgttaaaaaagatgggcaagttgtcgaaacaattactggcttccacaataaggaacaattaacggaaacattagctaaatatactgattagatggtgaaaatgggacaaaaaatccttaatttttggcaaaaaccagttgtcaatttcattggcagaacgattatatattttataattctcttaattttactctacctgtacgattacagtggtattggtagccctaaatttatttataatgaattttagatgacaaatagcattattcaaaaaattgatacaattgcgattgaacaaccgcaaactgtagcgtatcaatacggtcaaacgcagtattcatatgcagacttaaaagttgcatccgatcgaatcgcggcgtttatccaagaccaagcattgcctaaaggcgccccagtgattgtttttgggggccaacagttcgaaatggtggcgacattcttaggtgctgtcaaagcaggccatgcctacattccggttgaacaacactcagatgcagagcggattcaacaaattgaatctgttgctaaaccagcggctgtcctatcatgggcaccagctagtcaaattaatgttgatatgcctgtcttccaagaagcgacattagcagacgttgtggcaaacggtgcaacggattacgacgcacaacaaagtgttcaaggtgacgataacttctacattattttcacctctgggacaactggtttaccaaaaggggttcaaattagtgaaaacaaccttttgagtttcgttgattgggctaacccagcatttggcgttgctgataatagtcgggtcttaattcaagccccatactcattcgatttatcagtcatgaacctttatccagggctttgctcaggcgcaacattagtaattttagaaaaagaaattacggacaacttcaagaccttgtttgaagtattgccaaccttgaaggttaacgaatgggtttcaacaccatcatttgttgaaatctgtttactcgcaccaacgtttgatagcgaacattacccagaacttcgtgaattcgtcttctgtggtgaggaattaacgcaccaaacggctgaaaaattactcgaacgcttcccaagtgccaaggtgttcaatacttacgggccaacagaagcaacggtcgcaatgaccagcatcgaaattaccgctgatattctagcacagtatgatcggttaccaattggttatacaaaggctgatacgaagacggttgtggttgatgaacaaaacaacgaagtcgcacctggccaacctggtgaattattgattagtggccctagtgtttctaaaggctacttaaataatcccgaaaaaacgaacgctgcctttttcgaaaaagatggccaacgtttctatcattcaggagacttagtggttgccgatgacaatcaattaatcttctacaaagggcggactgatttccaagttaagatgcatggttatcggattgaactagaagaaatcgatcatcatttaggacaactagcacaagtgaaacaagcttgcacggttcctcgttacaacaaggcgcaccaagtaacgcaattaattgcttacgtcgtgccagctgaaggtcaagtgggggatgcgacattaacgaaaacgttaaaagcagccctggctgaaaatacaatggcctacatgattccccgacgtttcgtctatccagaaagtttaccattatccgtcaatggtaaggttgatcgtaaagcgttgattaaagaggtaaacgggaatgcctaaatgcctaatttacaaccgtacgcaaatcctaattacttcattattttaggcattgcgttagtgccgctaatcattggttttttaaatggtaaacggtggcacatctatgaaacacttgtttcactgctctttttggtcttaatctttgacggtgataagattaatcaagggttagctttaatcggctacgtgatattcgaaggggctctcatttggggctacaccgtgtatcgccaaaaacgtaataatacagcattgttcgacttggcggttgtcctggccatcatgccgctagtcattgttaaattcgtgccatttttaaatccaggacggaattcaattattggtttcttagggattagttatttaaccttcaaagctgtcggcatgattatggaaacccgtgatgggagtattaagaagtttgagccatggttgttcttacaattcatgctgttcttcccaactatttcatccggtccgattgatcgttaccggcgttttaagaaggattatctaaaagtacctgaacgtgatcactatatcgatatgttagggaaagcaatgcacaacttcatgttagggtttgtgtataagtttatcttaggttatgcattcggaaccttgttattgccaagaatggcgcacttagccatggcaagtcgcggcggtttcttagatatttcatggggccttgtgggttacatgtatgtctatagtatgtatttattctttgattttgcgggttacagtttattcgcagttgggacgagttatgtcatggggattgaaacaccaatcaactttaacaagccattctcatcaccaaatatcaaggaattctggaacagatggcatatgacgttatcattttggtttagagattacatctacatgcgactcatgttcttcttgatgaagcataaaattactaagagtaaagtattaatcgccaatcttggctacttaacgttgttcttattgatgggcttctggcatggcttaacctggtattacatcgcttacggattattccatgcaatttggattatcctaacagatgtctggttacgctttaagaagaaacataaggatcacattatcagcaatcgttggacaaattatctcgcaatttttgcaacatttaacacagtatgtttaagttttttaattttctcaggcttcttggaccgactctggttccattaaatggatgtagaaaacacagtagtagaaattttggcagatttaacaggtaacgatgatatcaaagatgatatggatatggatttatttgaaacagggacattagattcaatggcgactgttcaattattacttgaattacaaggtcaattagacatcgacgtaccagtttcagaattcgatcgtaacgaatgggcaacaccaaacaaaatcatcgccaaagcaaaggaattgcaataaatgtttaagaaattgtggctgatttttgggccagtgttaattgccggtgcgtgcttaggcgcgttactattatcgccatttcgctttagtcatccgagtgctaagactttatcaacagcggcaacatcaatgtcagccaatgtgattaaaggtgaagccatcaaggatgctgcatttaatgcggattacattcctattatcggatcttctgagttgtcacgaatggatcccttgcatccttctgtgatggctgaaaagtataattggaaaaataagccgttcttaattggcgcacctggtacacagtcattaacacatttcttatccctacaagcgacaggtcaacacctaacgggtaagaaagcggtcgtgattatttcgccacaatggtttgtaccacgaggggttaaatcagaaatgtttgatttcttctattcaccactgcaaacatcgtacttcttagttcatgctaaggattcagcagcaacgcgatatgcagctaaacggattctagatttaacgagtgatacaaccagtggggtaatgcgggatgcattaaagaacaaggcgttgggcttaccgctaacaacggtgcaaaaagtgtatatcaacaacattaagcgcccaggtttgcaacatcaagatcaactcttcagtcaattattcattcacggtcgtgaaaaagaattaactagaggcttgaaggctttaccagatgaacaagacttacaaacacttgaccaagttgccacaacacttggtcgcaaagcaactgctggtaatccatttgggattcaaaagaaattctatgaacaacggattttaccaaatcaagcgaaattgaagggcgaacaaagtaacttcaactatgaaagttcaccagaattttctgacttccagttgatgctcgatttcttcgcacaacacaagatggcagtgcaattcatcattccacctgttaacgcacggtgggcatcttatacgggcttatcacaagatatgttaaataacttctcgacaaagatttcttaccaattgaaatcacaaggctttaacaatattgttgatatgaccaaagatggtaacgaagattactttatgcaagataccattcatctaggctggcgtggttggttgaaagttgaccaacatgtgcaaccattcatggccactaagaaggctggtaaggtctcatataaattatcagatgactacttagatcgttcatggcaagatgttgctggtgatcaagtacaagattttgaagaataattatttaacgacttttaatactgattggatcatttcttcatacgcgattgggcctttgtacatccagcttgatgatttgtcatagctatagagttgcttgttcttaacggctttgacgttttgccagattggttccttgaacatagcagccccgcggtcgctgttaactaggaaaatataatcggcatccagttcagttagtttttctaaagaaacgggcatccagtcggcagttgcgtttttagaaattgttttaaccaactctggttcttttagaccgagatcttggtagagaagcgcgccacttgcggcgtgatcattgaccatgaaggctgagttatttgtaacccataaaacagcggctgatttattcggcgcttttgtttggattgttttcttggcgctggctaatttttggtcatagtcttttaaaacggcttgacccttatcttctttgttgaccgctttggcaacgtccttcaattgggtgcgccagttgactttagcaccatttttaacaacgtaggtcggtgctagtttgttgtattgagcatatttaccaccttgaacagcgctgttgtcacccactaaaatcagatctggtttagctttggcgacagcttcaaacggtaaatcatagttgatagtagggacatcttttaagtgttttgcaaggtagtcttggcgactggtcccgtttttgacagaccattgcacgactggtttgatatccagcgaaacaagataatcttctagatatgaaccaataacacgtttggggtgtgtgggaacgcttaccttatggtccatactatcggttatggttcgagtttgtttcttagtggctgttttggcttggcaactagctaagatgattaatgacgttaatcctaaaatggcaataaaacgacttgactttttcatatggcaattttagaaacacaacaggtcagtgtcggttataatcgacgcttaattattcaggatttatcaattcaaattcctcaagggcagattacaaccttgatcggacctaacgggagtggtaagtcaactttgatacggacgttagcccatttgttgaaaccgtcttcaggaacggttctgttggcagatcaggcgctagcgactaagacgcctaaagagatggcccaagaaatggcgttattaccgcaagttggggaattaacgaccgatttgtctgtctttgatttagtatcgtttggacggctgccttaccggcaacaattcagacctttgtcagcggtcgataaagaaaaaatcgagtgggcaattgaacgaacggggcttaatcaatttagagaccgtttcttgagtaccttgtcaggcgggcaacgccaacgtgcttggattgcgatggctttggcgcaagacacagatattttaatattggatgaaccaaccacttatttagatttgacccaccaactagaaattatgttattaattcaggaattaaatcagattgaaggccgcaccattatcatgacgttgcatgatttaaaccatgcggcccgtttttcagatcagttgattgccctaaagaatggtcaattacaggccagtgggacagtcaatgaggtcatgacgcgtgataatttacgacgtatctttaatattgatgcgacgttaattgaacatgatcagcgtcccttaatcctaacttatgatcgctggtcagaaggggaatagatgaataaaaaattcggcttttctttagtgattagtttgattctgttagccattttgatggttgtcagcattcgctatggtgcggcgcaagcaacgatgaagacggtctatcatgcggtttttgattatcacgcaagtcaattacaacaagccgtgattcatgaaattcggttaccacggattttaggcgccgctttaataggcgctagtttggcgggtagtggcctgattatgcaggaactaacgcaaaatccattagccgattctggcttattaggtattaatgcaggtgctgggttcatgttaacaatcagctttatcgtgttacctaaagcgacaccgcaacaaactgctatttttgccttaatcggggccgcattgtcagcctgtttaatcttagcaattagtatggctaaaaagacgcagaaaacggcgacggtagttttagccgggatggcgattagtagctgtctggttgctttaagcgaaggcctttctttaatgacccagcttaaacgggatttagcgttttggcattttgggggcgtcgcggcgattacttgggcgcaattaacacaactaggaccatggttgattggcggcctgattgcaagtctctgtttggcaccgcaactacgtttattacaactaggtgatgaacttgtattaagtttgggccgcaagacgagtgtcgtgcggttattgggctttatctgtgtcattattttagcgggtatttcagtggccttagttggatctgtcgcttttgtcggcttgatggtcccacacattacgcggtatctagtcggttacgatgtgcgtaaggtgatgccagtcacgttattattaggggccagtctggttgtggcagcggatttgatttcgcggacgattaatccgccacaagagattccctttggcattatgattgccttaattggcgtgccgttcttcatttatctagcgagaaaaggggcgagtcaagcatgaatgaatatgacgacaaaacgttatcggcgttggctcgtcgggttggtggctttgttaattgcaacgaccttgattagcttacaaacaggccaattagcgattggtccacaagcaatcggccaattattgattggtcagggtcaagcgcaagatgcgttaatcttagttgattttcggatgccacggattattattgcaatcttagtgggctttgcgttagcgattgcgggtgaagtattacagagtacgacgcaaaatccattggcagacaccggctttttaggaattaattcgggtgcgggaattgcggttttattatttattacatttgccgccgatcaaggtagtcagatttttatattaccggtattagctttgattggggcgttagtcagcgctgtagtaatcgtgatcggcgcgtatcaaaagtcggtggggattacggccaatcgcctattactaaccggagtcgcggtttcgacctgtttttctgcattaatggtcttattgaccttgaagttatcccctgataattatcaatttgtgatgacttggctagcggggagtatctgggggagcagctggccatttatctgggcgctgttgccatggttgttattaacattgccttatattttcagtaagagtcaaaccttggatgcctttgttttaaaacctgataacatgcgttcattgggagttgattttcaaaagcaacggttgtacttgattggcgctgcggtgatcttggcgggtgctagtgtttcaattagtggtgggattggctttattgggttgattacaccgcatattgcccgcagaattatcgggtatcagcaccgctatcaattactattaacgggacttttgggcagttgctttttattagttgccgatacttgtggcaagctattgagccctactgccgaaataccggccggcattatcgtggccttaatcggtgccccttactttatttacttactaatcaaaacgaaatgaatgactaacatttacgagacaacgattattggtggtggcccagctggtttgtatgctgcttttcaagctggtttatacggtttaaacggccaattattggaaggggatcaacaatttggcggcaaggttgccacttatgcggagcgtgtgattcacgatattggcgggatgcccaacattacgggccaggatttaattcagaatctaacagcgcaggccgctttttatgacatacctttgcgcactcaaaccttagtgacagacgtcaaatatctagccgaccaacattattatcaaattgacacgccggatgatcggtattatagtcaaaccttgatcttagcgatgggtggtggcgtagttcgccctaaacaattacggttgtttgaggaacaaacttttgaaaacgtccattatgcaccagccaaccctgaggattatcgggatcaacgggtggtcttaattggccctgggtataacttgatggaattggcgccgcatttgttagtgactgctaaatcagtggtgtggttaacgaccaagcgcccctttgtggatgaagcagctgaaaaagcgttcttaaccgcttatccacagattgactattactgccagccttttgcaagttatcaacaggtggatcaacaagtgacgagcatcacgttggcggatcaaacgcaaatcacatttgatcaagccgtggtcagtcttggctaccgccggtcattacagacgattgatcagtggcagttaagcgcagaacagattgaagaacgcccagatatttgggtgattggtaatcaaattccggatcgtgctgggattagcctgttaacaagtgcttttcaagatgggattacggcggtaactgagattgttgcccaacttaaaccaacggctaaaacgccgatggtcacgacgcataatccagttttccaggcggatacaaaagcctattggcaagaacgattacgatagttaatgttttttacggcggtgtaattcttgacggctagggagattagccacactactaaaggaagctttagcgaccggttcatgttccggttcaggtgttggttcagtagcgaccggtgtcactggttctgctggttccgtgggggcaattggtgtgacttcaggtgtctgcatggtcaccattgcttctgtttcaagcggaatttcaatcggatcatttgtatccgtttgaacaaaaatagtaactcgttttttattttcaacggttgccttagcttcagcagtgacttgtaattgttgctcaagggtttgggccataaaaccggcttcgagttggaagtcgggtgttttgaaatcggctagtcgcttagtgataatcggaccagtgagttcaaaaaagtattggtttttcttttgctttttaagcgataattggccaaagttaatttgttcgaagaattgactgagatccgcaattgattccaacggaaatttagtagctaattgcttaccagcccaataactaatgccttcagtttcatcacctaaaataagcggtaataagatatcgcggagcgtggcttgggctaggtaagtagcggtttgaggggtatctgtgagttgtgtataaagtgattgagtcacatgaagaaacaaccaattggttttatggattccggtgttggcggtttgacgctagtcaaagaagcccgcaaacgcctcccaaatgaagacatggtgtttattggtgatcaagcacgattaccttacggcgaaaagccggctgccacagtacgcgaatttgcttggcagatggctaatttcttacgccatcaagagattaaggcgctagtgattgcctgtaatacagcaaccgctgcggccttacctgacttacaagcccaattggcgattccggtgattggggttatcaaaccaggtagtattgcggccctacaaacgacgcataatcgacgtgtcggggtgattgcaacaactggcacgattcaaagtgcggcttacagtcaacaaatggcagcccttaatcctgatgtgcaagtgaccggattagcagcaccgcagtttgtgacgatgattgaagccaaccaacgacacggtcaagcagtgcaaaccatcgtcaatcagattttacaacctttacaaaaaagtgagattgatacgcttgttttaggctgtacgcattttccattattgacgaccgccattcaaacggcagtggggcctgacgtgacgttggttaacccagcagtccaagcgattacgatgttagaagaagtcttgacgcaacaacaacaattggcgacaaccacgccaggcacgctacggatgtacacaacaggctctgtcgccgcttttgaagagattgcgcaacaatggcttgcccaaccagatttaacagcacaacaagttgatattcaaaaggagaaaaatgatggtccggaccgataaatggtccggaccgataatcgagcagcaaatgatgtacgccctgtcaaagtacagtggcattatctgacgaaacaacccgcttctgtcttatggcaacgcgggacaaccaaagtattggcagctgtcactgagcaagcaactaagaaagtcacgctaattggcagtggcttgacgcaagtgcaaagtgactggttacaacagacgctaaccactttgttagcgcccgctctggaaaagacggggttactggtgtcagtgacggttttagaagacggtggtagtttactagcagaagctagcaatgccgtttttggggccttgcaattattacctgaacaattcttacctaatcgtgcagcagccgttacggctattctgaccggtaacgaaaccttagttgatgccagtgacacggaagaagcggttgctgatagcacattgttagtcgtgactgataatcaagaacaagttttagcgatgacattacaaggcgcaacggcggttaatagcagtcagttaaacgaattgttattggtcgctagccaaggcggtacacggactgctgaacagattcaagcgagttatcaacaagctgtccacccaatcattcaaaaggagcactctgagatgccaacaattgtgattgccactaaaaacccgggcaaggcccaagaattccatgcgatgtttgaaaaagaggggatccaaattaaaacgttattggattaccctgaattaccagaaattaatgaaaccggtcaaacctttgaagaaaacgctcgtttaaaggctgatcagattgctgctattttacagctccccgttttggcagatgattcaggcttaatggtcgatgccttagatggtcgtcctggcatttattcagcacgttttgcgggtgatcataacgatgccggcaataatgccaagttattatacgaattaacgggcgtccctgctgaaaaacggacagcccatttccatacaacgttagtgtttgcgaaaccagatcgacctaacgatgatttagtggttgaaggtagtgttaacggtcggattctaggaattccccgtggcgataacggctttggttacgatccgttgttctacgtaccagaactagataaatcaatggccgaattatcgatggccgagaaaaatgcgattagccatcgtgcaaaagcgattgaaaatttagaaccactttggcgtgattggttggcaaaatagatgcggttagtagtagtcagtgatagtcatggcgatcgggatattttggtgcaattggttgcgcattataaggacgaagtagtcactttcttacattgtggcgattccgaattaacgacgaccgattcattatttcaacaaatgacggttgtgcaaggcaacatggattttaatggccacttcccagaacaagtggtggtgccagttggggcgcaaaaggcttttttaacgcatggtcatttgtacggtgttaattttgatttaacgcggttgatgttagcggctcaagcagaaggcgcgcaattggctttttacggacacacacatcagttagcctgtgaaatgcaccaagggctcttggtattaaatccaggcagtatttcgcaaccgcggggccaattccaacccttaggtggcacctatgctgttgtggatatcacggcgactgactatcaagtccaatattatgaccgccattttgaaaaagtaccacaactccaatttaaatttaaaagagcttaaatgatttcagatgcgtttcagaatttattactcgaaaacaaagaacattttttaattcctggtgaaatggtcgctagcgttcaggaaaataactcgttagaacatgcgtttattctcttaacaactgttaaatattcaagtattccggtgctcgataatcattcgaagtttaaagggatgctaaccatgccactgatcacagagacgatgttaggactcgatcacttgagtttcgataacctccgtaaaatgaccgttcaagatgtgatgcaaaaggatgtcgtgacaattaaagatccatacgatatcgaagaaacacttcatttgttggttgatcatccgtacttaccggtattatcagacgacggcgaattcacagggattgtgactcggcgcgagatgatgaagagttttaaccgggtagcccataatattgaaaaagaatataagattgaggctttaccaatagagaaacaacaagattagttaggcgcgatcaaagtaaatcgttgcaatggctcctaagacgagcatcacggcaattaatgcgattggccctagtagtgcggttaaaccacccacggccggccaagcgggtacaacgcctgtttcagctaggatccagatggctgctaggatcacgcctaaaacgccagcataaacatattgggcatagtgagcgagtaagtaatgcatgattttagcgacaatcacggtcccaatcacagcgcctagcataaatggcaagaggagggcgacacttttgaaagcctcgcctgcctgttcaaagcggccggtaacgagataaacgagcaaatcgagtaattggctaacggcgtgatagacggtaccatattgtttgataatcattaacatgatcgaacccgaaacaccgggaatcaccatcaatgaaacggagaaaaagccggtaaaggttaacatcccgaaatcttggagggacgttagttgtttgatggcaatgtcagattcgttttgatgaccaccaattttggtaatcaataacatcaagccaccacaggcaatggcaattaagacttgctgccagtttagctttttaagcttgcgccagatgaacggtaagctacctaaaacgaggccgatgaagaaactataagcggccagtggataagcggtgcataaccataaaataactttggtcgataataatacaccgatgcccgcgccaataccgattggccataaaaagccaattgcttggcgccaatcttgtttgaactgcgcgatggcctttaataatggttcatataaaccaacgatgacggcaaagatactaccagataaaccaggaataacgagtgcgacaccgattagggcgcctttgagtgcattaattagtggcatttagttggttaaagtcaatgaactggtgggaagggtgataccagcagcgttaattgcctgcaagtaaccctgtaaaaataagcgttgcgtcgttgcttgttcgccgttaagcgtgtgcatcaccacttgataagcgagtgtgccgtccgttaaggttgaaacccccagtaatgtggggccgtctttgatctcaggatggcgggggactaattcggtgttaacttgcttaacaatcgttgcgagctgttcgatatccgtatcggggttgatgcgaatattaatcagcactcgcatattattacgggagagattgctgacgattgagatgttacggttggggatgaaattgagcgtgccatcgtagctttgcacttgtgtggttcgcaagccaatcgctgtaacggtaccttcaatcgttccaattcggacggtattgccaacgtcaaattgttgttcggcaaggatgaaaaagccagtgacaatatcgttgacaaatccttgggcaccaagaccaacggctaaactgaagatcccagcaccggcaattaatgtcccgactggaacgccgataatgctgagcagtgcataaaggtaaaagaaaattagcagataagctaaagcgttggtcatcagggtatagatggtattcattcgattgttggaaaaaccatctgcttcgcgatatttgcgaaaggcccgtttgataataaaacgcccaatgcgactaagcaagtaaaaaagtagtgaaattaaaatgatttgaaaaaagccagtgatgaagaggcctaagaggtgatcccaatcgatgctggttatatagcgcataaagatattggtttgcttttgaaccgactcgacgggtgtggtggttagtgattgaaagaacatatgacgggtggtcaaattgcagcattaatcgctgcaggggcttttgcagttttggttgtttttctaatagtgatgttattaaaagtcactaaggttttaacgcgtgtttccgagacagtcaccgaagccaataagagcgtgacaacaattacgaatgatgtagatgtcctttcaagacaagttgaaggtctgttgaacaaaacgaatgttttactagacgatgtcaacggtaaagtagcagatttagatccagttttccgtgcagccggcgaattaggcgagagtgtttcaagtttgaatgctgccagtcgcggtttgactgaaaaagtaacaagtgtcggtcgcacgaccgccaaagcaacagttgcttctaaaatgggggccagtgcccttagattctatcaaaatagacgacaaacaaaagacaaggagtaaatggcaaaaaaaggctttttattcggtgttttagtgggcggtgcagcagcaattggtgccacacttttattaacacctaaaacgggtaaagaattacaaaataaattagtggacttgggcgaagatgccattgatcgcgcacaagactattattacttgatgaacgaaacggctgctgatcttaaaggagaagcaaagttccatatgaaccgtgtgcatgattatgcgagtgattggcaagaaaatgcattggatatcaaagaacaagctaaagcgcaatttgatgaaaagacggcagacttaaaatcacaattcggtagtagcttagaaccagctgctgaagattttgatgatatcgtcattgaaggcaagagtgcttttggccaagccaaagatgaagcagaagaaaagatggcaccagattcattaggtgaataattagaatgtttgtagttcttttgtcatgtgtgtgaatgattctgcgcctgtttctgtaacgtggacacagtcttcaatccggacaccggcaacacctgggatgtaaatccctggttcgattgagaagcacatgcctggtttgataatcatgtcgttaccttccatgattgatgggaattcgtgttctgaagtcccaatcccatgacctaaacggtgaataaagtattcgccataaccggccttcgtaatcacgtcgcgggcaatcttatctaattcagcagctgtaatgccgggtttaacagcatcttgtgcagctaagtttgcttcaagacaaactttgtggatttcaagtgacttagcatctggtttaccaaaagcaacagtccgtgtcgcatcactcatataacctttgtgtaatgtcccaagatcaaagagcactaatgcatcaggtgttaagatattagcttctgggccaccatgtgggttagcagcgttgatgcctgattgtacaattgtatcgaaactcatatgcataacgcctttacgcattaaagcatattcgatttcagcaacgatgtcttgttctgttttgccagcttttaaagcgttgaaaccaacttcaaaggcgtagtcagcttcgcggccggctgcttccattaaagcaatttcttcaggtgttttgattaattttaagttttccatgaagcgtgatgcatcaccagggaatgttgcgttagggaattgctttagaattgcttcataacgttgaacgggaaggtcgtctttttcaagagcccaacgtgttgggttggccatccgtttcttgatttgatctccgatgatggcatatggatcttcatgatcaaggtaaccataaacatcaagtttccagccagccttcttagcagattcaacttctagttgtggtgtaaataggaatgggtcctgatctgcaaaaacaaagagggctaaaacccgttctgcaggatcactttcaaaaccagtgaaatagaggatgttcgttggattactaatgtaagccacatccatattattctcgacaagccaattttgtaattgggctaattgattattcatatggaaaaacaaacaattacaatttacgacgttgcgcgtgaagctgacgtatcaatggcgactgtctcacgggttgttaacgggaaccccaacgttaagcctgccactcgcaagaaagtgcttgaagtgatcgaccgtttagactatcgtcctaacgctgttgctcgtggtttggcaagtaagaaaacaacaactgttggggttattatcccagacgttagtgatatctactttgcttcattagcacgcgggattgatgatgttgccacaatgtacaagtacaacatcattttagcgaactcagatgaaaacaaccaaaaggaagttcaagtattgaataccttattggcaaaacaagtagatggtttaatctacatgggtcacagtatctcagatgcaatccgtgctgaattcgcccgttctaagacaccaatcgtattagctggttcaatcgatccagacgaacaagtcggtagtgttaatattgactacgttgcagccgttaaggacgcaactttgaagttaatcaagaacggtaacgaaaaagtcgccttcatctgtggcaacttagattttccaatcaacagcaaatatcgtttacgtggctataaagatgccttgaacgaagctggtattccttatgacgaaagcttaattttcgaaacagaatacagttacagtgctggtgaagccttattcggtaaggttcaagcaactggcgcaactgctgctgttgtcagtgacgatgaattagccgtaggtgttttaaatgctgctgttgatgcaggggttaatattccaactgactttgaaattgtgacaagtaataacacgaagttaactgaaatggttcgtcctaagatgacatcaatctcacaacctttatatgatatgggtgctgttgggatgcgtctgttaacgaagatgatgaacaaagaagaaatcgatgataagacaatcctattgccatatagtattgttgatcgtcaatcaactaaataattactctgattctgattgactagcttttgtttcaccgtacgtaattgtaccgtagccgttattataacccatataatgattccagaaggtttcgtaattgctgcttgtgccaccaattccgaattcgtattgcgttgcttctggtgtccaattattgtaaagcgaagtgaccttaccactgtcaacggttcgcgtattaccattaatagaaacaatacctggcagttgaccagttgctttaacaactttgctacttgtaacggtacttggtttttcatgatcttcttcaagcttcatgatacttggatcattttgatagacgctattggctaacttagcccaatagttttgattaatcgtgctagaactatcggttaagttacgaccggtactgtcatagcccatccaagaagctagggtaatccctggcgtgctaccgataaaccaaacatcccggttatcattattagtcccggttttaccaactaggttattagtgttgaagtagagttgatcgctcaattgtgttgcggtcccatccgtatccgttaaaacacctgataacatttggttcatgatgtaacttgtcgccttcgagaagacttgtgttttcttagtgtgatgtttataaatgatattaccagcagggtcagtaatcttatcgatcacgtaagcatcaacgtgttggccttcatcggcaaatgttgtaaaggcacttgcttgggcgagcacgctaatcccatctttggttccccctaaggcaagtcccaattgactatattcatcatcagaaaggtgaatccccatcttatccatataggtcgcagggttagtcgttttacgtaacttattgtataagttaacggttgggatattgagggattgcgctaaagccttatccgcagggatgaacttgttttggatggtgttaccgtaatcggttggcgcataagttttgaagttagttttaaagtcagccaacatcgttttagaaccgattagtttttgatcaatcgctggaccataaaccaagagtggtttaatggttgaacccggtgatcgtttggttaacatgtagttagtttgtttgagggagaagtcgcgacccccaacaaatgaaatgactttaccagtctggttatcaagtaagacactcccgttttgaaccggtgtgtcgcccactgattgcaaaccagtaattggatcggtcgttgcatcttgataggttggtccaaaagaactgccttcttgtttgacgatttcttgcattgaatcatagatatctttgtcaattgtactatggatttgatagcccttagtacttaggagttcagttgcctttgtttcatattgtttgtagagcgttgggctactattaagcttttcagtcgaaacattagcttcattagcgagttgtttcgtcatgatgtcggttgcttgtgattccaaaaggttataaacgtaaccataacgcttagaagttgattcaggttctgctttagcttggaattcactcgttaaatcgactttcttagcagctttgtattctgctttggtaatgcggtcatcacgatacatccggaataaaacggtattcttacggtctagtccgtatttcaagtattcaggatctttcaaggtaccatcttggtcatatggtgtatagacggaagggctctgcggaagaccggcaatataggcggcttcggctaaagacaagttcttggcatctttaccgaataacccttgagcggcttcttgtacaccagcaacgttttggcctttattatttcgacctagggttgcaatgttgaggtagtcttgtaagatttcctttttcgtgaagtatttatcgacacgtaaagcaagtaagacttcagtcgctttccgtttgaaggttacttgagacgttaagacctgcatcttaattaactgttgtgttaaagtcgaaccaccggtttgagaaccaaagccggttaaatcagagatgacagctcgtaagagggcctttggaacgaccccttgatgtttatagaagtcttcatcttcagttgcgacaatcgcatcggttagataaggcgacatttcattgatgctgacgggtgtccgcgagagatcagtcttaattgcgccgaattttgtgttcttggcaaagtaaagaccggccgcttgatcagtgttatcaagttgttgtttaagcacttgataacttgggaccggttcatccttcatcaatgcggcaaagtagccggcaccaatcccaagacctaaggcaaacataatcaaaccgattgaaatgccgtagaggattaaacttttaagtgcttctaaaaagacattaagcttaaaagtgaggggtttggcactaaattgatcgacaaatgttcgattttggtctttgtcttgatgtttaaaccaattgttaagccaaggcattgaatgtgataatttcgttttaatcttggaaaatagcgtattgactttgcgacgccctttagagatgagggctgatgcgtgcttttgccgttggctggaacgctgctttgaatctttcaaatgaaaattattaaagtaaaagatcaagtagaaggcggccaaaaaggctttgaaatcttcaaagaaggtttagcaaacgacgcgaaagtattcggtttggcaactggtagttcaccaatcaaattctacgaaacagttgttgcaagtgacctagacttcacaaactgtacatcagttaacttggatgaatatgttggtttatcagctgataacagccaaagttaccactacttcatgaaagaaaacctatttaataagaaaccatttgcaaaatcatacttaccaaacggtttggcaagtgatattcctgctgaattaaaacgttatgaccaagtcattgccgataacccagtagacatccaaattcttggtatcggccaaaatggtcacatcggttttaacgaaccaggtgctgcttttgacagcaacacacaagaagtgcaattgacagaatcaacaattaaggctaacgctcgtttcttcgaaaacgaagcagatgtaccaacaaaagcaatctcaatgggcattggctcaatcttaaaggctaagaagatcgtcttgttcgcatacggcgaatcaaaagctgaagccatcaaaggcacagtagaaggcccacaaacaacagacgttccagcaagtgctttacaactacacgacgacgtgacaatcatcgtggacgaagcagcagcaagcttgttatcaaaatagttatttcaacgttgccatcacttttgccattgcggcttgttgataggccatcgctgcatttttagcaactgcttgtcgttgcgttgcagtcattgctggattagcttgcatggctgccatcacagcttgtttaccggcgttagttgcgcccgctttgagttgtgcttgttgactctttaatgttttagcgagttgtttagcttgagcgtcgcttaaaacgagccagcccttagcaactttgaaggtattgtggcggctcacgaattcgtggtcattgccagaaataccaaaccagaatttagccatgtcatttttatacacacggtatttggtagtggttactaaggcagccttatcagcattcttttgaacactgttggttgtcttttcagtttgggttgctttaggtttactttggtggatatcagtccgataaaggtaaactttttcggtaccattgccaagtgggtgatagagcaacattgacatgcccttagcatcggcacttgaaacaagggtttgtgtcttagtttcggtcacagttttcatgccataatgattgtgatcattttgaacgatgaaaaagagtgacgcgataaaagtgagaccgaaaatggtcattaaaattgggcgccacattttttgaccgaagattgaagcaaagaataacgcaagtgtactaataatgagtgtaataacgatcattcatgctttggcacctccattagtagttgatttcttagaggagaggaagaatgtgataatgaagccgatcacacagaaaatcacggcgacgataaaggcggcgtgataacctgaaagggttgcattaatcattttatcacggaaggccaatggtaaggtcttgaccatgtgtgtgcttggcatattgtttttggtaacacttgaaagcacactgattaagatggctgtcccgattgagctggcaacttgccggaaagtattattaaccgctgtcccatgactgattaagttcattggtaaagcattcatcccagaagttgtaacaggcatcatgaccattgaaatcccaaacatccgaacggcatataaaacgacgatgtagatgattggtgtcttagcagttaaaaagataaatggtgcagtagcagccattaataagaacatcccggtcatggccaaacgttttgcgccgtacttatcaaaaatacgacccgtaattggcattataattcccatcatgagggaaccagctaataaggttaagccagaatggaaggcagattcgccacgaatattttgaatatataatggtaagaccatttcggcaccgaccatcgccatgtttgtcacaccacttaaaatagcggcaattgtgaaaacgggtgatttgaagacgcgtagttccaagaatggattttccattgtgagttgacgccaaacaaagagggcaattacgatgacgccgactgccaaggtagcgaggacaagcatgtcgccccaacctttatctccaacttcagagaagccatagagtaaactaccaaagccgacggttgataaaataatagaaggaatatcgattttaggtttcgaaagttggataacgctcttcatttggaagctcgctagcactaagacgagtaggacgattggaataatcattccgaataagacccgccagttgtatgaatcaataatccaacctgaaagagtaggtcctaaggcaggtgcaagaccgataacgatcccggccatccccatggctgtgccccgtttttcaggtgggaaaatcgtgagcataatggtttgcaagatgggcattgaaatcccaacaccggcggcttgaataagacggccgattaataaagttgcaaatgagctcgttggtgcgatgtaacaaataatggtcccaagtaaaaagacagtcattgctgacatgtagaggacctttgagttgaatcggttaattaaccaagcactaatggggatcataatcccgttgactagcaagaaaccggttgtgagccattgaacggctgaagtggacacgtcaaatgctttcattaatgtggggaaagcagttgataaaatcgtctggtttaagacagtacaaaaagtaccaatcaataagaccaagactaagactgtccggttgtatggtttcccatgaatatctaatggtctagagtctgacaattgcaaaaagacctttttttaaagttgatagatacggatcgattaatttttgggattagtgaagtttgtaagatggcaggggtgacgccgcgtcaactccgctactgggaacaaaagggctacattaaggcccgcgaagcagatggcaataaggcccgtgagtacgacgctcaaatgatgattaaggccattttcatcaagcatttcttagatgaagggtacacgttgagcgttgcggtccaaaaaattcaaaagcacatggctaatatgaagattgtgcgatcgattattcgggaacatttcgaagggattgaagaactagatggcgaaatggctgtgaatctcgggtatttcgatgatacaaaacaacaaattttatatgcgattgtcaaagaagggcattcaacctttaaattagtggatgcaccgactaaagaataaatggaaaaacgacaatatttgcagtttatcaacgaagggtacggctttgaattttatttgaacctcgtcggctttgtcgcagattttaacggcagctatccaactgaacgggaatttaaaacgatccttgaagaaaatggtgtggcttatacggcgattagacggcataaactcaaacaaatgtatcctgagatgtttgcgaagcaacatcagggacatgaagacgctaagcaatatcaatttgatttggatcatcaggaattaggtgttcagcgagtgtattatgcttatagccaacctgaattggttgatgaacagggagcaacatgtctgacgacgacaacgccgacttttgtcacgcggcaaccacggtatcgccttttcgataacagcggtcagtattatctttttgatgtgccccaagatcaatttgaacaacagttaaatgcactgcctacggaggtgctcgattttgaacaaccacatgttgctggaattttaatgttgatcgagcaggttaaacaattggggtatacggtagtgggctatcatctaagtcacatagaatcttatccggtcgtcgaaccggcgctcctcacggcacttatcaaccatcagcaagagacgcaccaacccacttttgagccaatcaacgacttgctgaatattaaaacggattatcgtagtttgttgtgttacgacgatcagttgaaaatactggttttcaataaagaatcaagtcaacagttcgggcgggatgatgaactgtattttaaaattcgggatgcagcggggcaagtcgtctttgaccgtttgacgttggatatccttggcacgattttattttgtgtggggcaacagttaccactcgaacagattcaagccgcttttttaacggatccaaaagcgtcatttaaagcgggggaggattactttatgtatgatcgattggcttgctcggctgaagtgccaattgaaaccttaaccgatattaaaaaggtggcactgtgctcagtagatacaacgcaaacgattagtgaatattggcggtggtcgcctcgtgatttaatgcgttatggtaaggctattatgccggaggactttggccaaccagcaccggcagcagccctcatgctggcatttaatcaacaattgactaacgcgttgcgtcgtattttgaagcaatcagcttggcaggttcgaaaagccacgcgccaatttttagtactagaagacgttgttaatgttgatttagcgcttgaagatagtcaatcggaagaggcattgagcgcggcacaacagatttatgctgctcaaatgaagacggcggcagaaacgcgctatgatttgctagtcgatggtcaatgtgtcttgcaggaagttccattagacgaattattaccggccattatggaatttgctaatgaataattaacgtgttaaacgataaattgcgtctgcatagatggcaattgcgttcatgatatcttcgatatgcatgtattcatttgcttgatgcataacattttcgcgttcttctggtaaagcaccgaaagcaacaccacgttctaagattcgaccgtatgtgccaccaccgataacttgttcgtgacctttaagacctgtttgatcttcaaagacttgtaataaagttgctactaattcgtcatcaccaggaacatagtgaggtgcttgtgcatggccttcgattgttacgtcggcaacatcactaagtgtcttagcaaggccttcgcgtgtactttcatcagttacacctttagggtagcgaacgttcaagagaacagatgcaacaccgtcttgtgtgtagttgaagacagcagggcaagctgttaaatcacccatcacatcgtctgtatggttgatgtttaagaggtgaccacgtgagtcttcgtgcattaaacgagcgattgtaccgatgtagttgccacctttagcatctaatgcaaagtcagctaagaatgttgccaagtgagttgcagcatttacgccagctttaggttcttgggcatgtgagcctttaccgattaaatcgattactgtttggtcaccatcagttgtgatagtaccttgtagtttgtgttcagctacataagcatcaaatttagcttggaaatcagctggcattgcaccagttaagattgccttagcagtttgaggaaccatgttagcacgtaaaccagacttgaagcttactaatgtcatttcaccatcagcgccatcaactggtttgaaagtgatcatgtatgacacaattcctttttcaccattgatgattgggaagttagcatctggagagatagcaaaatcaggttttggttcaacttctagataacggttgataccaacccattcactttcttcgtcagtcccgaaaatgaagtggacttttttgtttaatttaatatcgttgtcttttaataatttaagcgcatagtatgctgcaattgatgggcctttgtcatctgatgaaccacgggcataaatcttgccgtctttgataactggttcaaaaggatttgtttcccaaccgtcaccggcaggaaccacgtcaacgtgacctaaaataccaaaaatttcgtcgccactaccaaattcaatccggccagcaacgttttcgatgtttttagttgtaaaaccgtcacgatcagcaattgctaacatttgtagcaaagcatcacgagggccagggccaagcggtgcatcgtcttctttatgttcaacgtcacgcgcgctattaatcttgagtaaacttgttaagtcggtaagcatttgatccttatactttgccgcttcttgttgccaattcaatgtcatttagttcgattttctcataatacgcaaggcatttaaaatggcaattagggttacgccaacgtctgcaaaaacggcttcccacatggttgcaatgccaaatgcacctagtaataagaagattgctttaacgatgagcgcaaaagcaatgttttgccagacgattttgcgggtgaaacgggcaatatcgatggcagttgctaacttagttggttcatcggacatcaaaacgatgtcggctgcttcaatcgcagcgtcggaacctaaaccgcccatcgcaacaccgacatcggctcgagcaagaacgggggtatcattaatcccgtcaccaacgaaggccaccttgccgttttgcgcacggttatcagtcaggctggctaaagtagccactttgtcttgaggaagtagttcactttgataatgatcaattcccaatgattggctgacttgtttagcgattgcgtcgttatcaccagttagcatcatcgtttggcggatgccgacttttttcagttgcgcaattgctgtggcagcatcttttttaagctgatctgaaataacgaggtaaccaagataatcagtgccataagcgatgtgcaccgcagtaccgacttcagtaggtgtgagtggtgttaacccttgttccttgagccagctagctttacccacttttagggattggccgtcaagagttgcactaacgccgtgaccagcaacttctgtgaccgcactgagtgtttgattgagtggtgcttgattagcagcaatgatggattgtgcaatcggatgtgttgagtgttgttctgctaaagcggctaatgcgagtaaatgtttcggttgatgatcgacagcgtgaattgctgtaacggtaaaactaccttgggttaacgttcctgttttatcgaaaacaactgtccgcacatcgtttaaagcttcgaggtaattgctccctttgaccaggatgccgtttttagaagcagtcccaataccggcaaaaaagccgagcggaattgaaatgactaacgcacatggacaagaaatcactaagaagatgagtgcccggtagagccaatctgagaagggttgtcctaaaaagagtggtggtacaactgctaataatacggcaaagcctaccacgattggggtatagactttcgcaaagcgagtgatgaagttttcagtcggcgctttttggctgctagcattttcaaccaggtctaaaatcttagcgaccgtcgagtcagcgtaaggttttgtgacttgaagggtcaaaagaccggattgattaatgctgccactcaagagggtatcgccaacgttaaatgaacgaggcaccgattcaccggtgaccgcagcggtatcgacaaaactactgcccgcgatgacggtcccatctagtggtactttttcaccaggcttaattaaaatggttgcaccaacttgaacggcttcaggcgcaacttgttggaggccttggctagtttggaggttggcaaaagtcggtttaatcgcaaccaaactagcgattgaatcccgtgagcgattgattgctaaactttggaaatattcaccgacttgatagaacagcattacgccaactgcttcagcgtattcgccaatcccaaaggccccaatggtggcaacggtcattaggaagttttcgtcaaaccattggccgtgaagaatattccggatggctgtccagataatatcgtaaccgatgaggacaaaagcgactagcaacaagctgattagtagcggctgactaagtggtaagacgtagcttcctaatagtaaaaggccgctaatgataattcgaaccaagtctagattaaatttaaatttcttagggggtgtttggcccgcagccggtaatgatttttgaatggtgacatctggttcaattgtcgttaacaattgttgaagctctaattcaaacgcggtggcggcttgatcaccggttaattcataactcagtttttgcgtcgcaaagttaaccgcgcaatcttggacttgcggtaattttttgacgtttgtttcgattttggtagcgcaggcggcacaatcgatacctgctaattgaatttgtgtcatttagtgctcgttaacgtgcgcgatgacttgtgagaagatgttaatcacatggttgtcagcaagggagtagtaaacttctttgccttctttgcgactcttaacgagctttgcttgtttgagtacccgtagttgatgtgagattgaagattgtgacatctctaaaacgctgacgatatcgtaaacccgtaattctgattggaagagtgcgtacagaattttagcgcgggtcttatcgccaagaattttaaaaagtgttgagatatgatcgagcgtgtcttctttcggaagtgttttttgaacggagcgaatcagttgatcgtggtcgattgtcatttaccggtaataagctaatgcaatggttggtaaatcagtattaggatccaattgaatcaatgcttggcgacttttgaaccagccggttgcggtttggagccaaacctgattgccaacatagcgaacggctaatattttgtggcgactattagctagcagctgaccggttgtctgggtcggatgcaagggactattccaagtcgcaacagtcatcggattgggtttgatctgggctgttttgcctaccaataaggaagctgcttgggcggtttggccaacattaatcgcatcgcttaatacaaaccggttagtgccaattcgataataggtctgatcggcaaccgtgacggtttgggttacgtcgtagctatgaccagccttagccggtgctttagtgggcacttgttcgtaggggttttcaacggtggttaaatcgtgaacgctattgacctgaccagtcgtttctaaggattcaatctgggattgatcttgggcggcttggtaatgtcggcctagcgcgggataattagtgacgacgccatccacatcgaggttaacgagccagttccaagtggcttgattttcggccatttcattccagacgtagactttttggtggaggtaatgcaattgtttgataatcgtcggcgtcactaattcggaagaaatgttaattccgtccgcatatttgaagctttcaaatgaaatccgcttgagactacccacgataaaaatgcggggaatctcaggcattagtttttgcatattgattaaacttggtaacgagaaggaatggaccatgatccgcttttgcaggtgatacttttgaatgagcgcaactaatttggcttccatgtcctgcgggttacccttttttgttttcttggtttcaattaagaatttcgcattggggttgttctgatagtgttggaataactgttcaacgctatggacaggttcaccattactcatttttagtgtgcttaatttggcaaacgtgttttgagaaacaatggtgtcgacaccggtgacacgttttagattacgatcgtgcgagatgactaagacgccatcttgagactcatgtaaatcgagttcgacgtagttggcaccttgcgaaaaggccatatcaatactctggaatgtttcttccggggcattaatgggatcaccgcgatgaccaacaactgtaaagccagataataagagaaagtaaaagcagcaaaagagcacgatgcccagttgtgatttggactttaacaaatggcagagaaacaacaagtgtttgatattattgaagaaattacacgcttagacggttcgacgtactatgagttaggcaatatttttatgaatgggcgggcagaacttgctgccaatcgcgggttaattaagggtgtgcggattttgcaattaaacattccacattctaatgccgttcaaacttacgaagactatattaatgagacttatacgatgcccgctgttgattttacagaatgggaagaatgggagaaaacaccggggcctgtcgaagaggcttttaaagaagttttaaaagcaaatcatattggctagatgatttattttacagcggatacccatttctatcatgaagaattactcgggatgaatgactttgcgccacgaccgtttgcggatgtggccaccatgaatgagacgattgtgactaactggaatcagcgtgttcaatcggaggatcaggtttacctattaggagacgttgcattagtcccgaataaaccaactgcttttgcgcaagttaatgctttgctcggcgcattgaatggtcagattattctggtgaagggcaatcatgacaaccgtgccttctttaaatatttgaagaagcacgatccgggaacagaggcacacccgcactatcaatttgtcgatgtcggggcgctaattaagattaatcaccggcagtatttcttaacccattatccgctgttactcggtaaagttagccaaacggttaacttgcatggccacattcaccacaacatgctaccaattgctgagaatatcaacgtggggattgacgccccagaacgtgaattattgaaaacaccactaccatttgggacacctttatcagtagcggagattgaagcaatcttgacggcaaaacaaaaggcgttaacgcaattaaaataaatggaaactattcacatcttacacacgaacgacttacactcgcattttgaaaattggcctcgaatgcgccgcttcttgttagcccaccaagcggcctatcggcaaaaaggtgaaacggtcttaacgtttgatatcggggatgcaatggatcgtagtcaccctttaactgaagcaacagacggccagattaatacgaccctgttgaatcaaattggttatgatggtgtgacaattggtaataatgaaggcattggcaatagtcatgcacagttggaacatctatacgatcatgcgaatttccctgtattgttagcaaatctctatgaacaatccacaaacaccctcgctaaatttgcgcaaccgtaccgcattatcacaactgatcaagggacgcggattgcggttgtcggattaacggcgccattctttttgacatatcgacctaatggttgggatcctgtcacaattagtgaagaaatgccacaattactggcgcaaattgaagggcagtacgatgtcttagtattactatcacatctgggcttaacaacagatcaatggttggcagaacactatcctgaaatcgacgttatctgcggcgcccacacacatcatctcttaaaagatgggctgatggtgaatcaaacattattaacggctgccgaaaagtacggtcattatattggcgatatcacgttaacactcgatgctaaccatcgcccggttgaccggaaagcccgcactgtcttgacggccgatttaccagaagaagcggcggatgaggctgaaattgcgggttatttagcacaagggcatgcccaattagcagcccaagtggtggccgacttgccagaagcactgccgattgctaccattggagagtcaccgatgatgacggccgggttaaaagcgattgaagcggcaacgcaaacagaagccgctgttttgaacaccggcctatttttaggggggctcgaagcaggtttggtcaccaaagatgacctgcagagtcaattaccgcatccgatgcatttgattaaagtcactttaaagggctacgatttatggcggttagtcttagaaatggaaaaaaatcggttattcttacgtaagttcccgattaaagggatgagtttccgtggtaaaatctttggagacatcgtttatgatgggattacagtggatatgacattacgccgcgtcttttggcatggtcaggagattgatcctgaagctagctatacgttgacgacagttgatcattatctctttattccgtttttcccaaccattgaaattgtcggggagactgaaattatgttccctgattttctgagaaatgcagttgctacctatttaacacaaaaatatcccgtttaagtggcggatacaaaaacaaaaccgaagattgctaagaaggtaactcgggcgcttgaaaaagaaatgattgcagcggctaaacaaccggaagtaccacagcacgtcgttgttaagagtgaaaccatgattgacatcgataagtgtgcctacgaagtggtcgccaattatcgcgatggttttgatgctgaaaagctaaacgaacgctataacgaggttcttgcgaagtacgattatattgtggcggactggggttttgaacaactacgccttaagggattctacaaatcaactaatcgacgggccaataaggatcaattaattgatacactccaagactacctatatgaatattgtaattttggttgtgcctattttgtcttagaacgacaaggtaaaccacagattcgcaacgaaaatcgccgtagtaatcgccggcgaggaccacagaaacaacgccggcaaaagcaaggcttcacggaacgtaaagtaacacctaatcaaaaagtgactaaagaacagccgcaaaaagcggtcacggagaataaaaaatccgttaataagcgccactttaagattcgaccattagagagtaattccccaaaggaaactggaaagtgaatgacaaaaacaaactacgcaggctacttaatcgatttagacgggacagtttatcgcggtagcgaacagatgccagaagcacgtgattttattgaacggctccaagctaagaacatcccttttatgtttttaacgaataacaccactaaatcacccgcagcggtgatcaaaaatttagcagataaccatgatattcatgcaaccgaagaccaagtttacaccccatcattggcaacggcgcgttatttgttaaacctaaatggcggtcaagcaaatggcaagacagtgtatgtcatcggcgaaattggtttgaaacaagctttattagatgctggttttagaactaacgaatatgatccagactacgtggtggttggcttagactacgatgtcacttaccacaaatttgaattggcaacgctcgcgattaaacgcggcgctctttttattgggacgaatgccgataccaacttacctaatgaacgtggcttagtgcctggtgcaggttcagtgattgccttagttgaacgcgcaacacaacaatcagcgctttatatcggtaaaccagaaaaaattattatggaaatggcactcgaacaattcgggttaactaaggaccaagtggtaatggtcggcgataactataatacagacatcaaagcgggtttaaatgctgaaatggcaaccttattagtttatacgggcgtttcaacaccggctgatttggcaaaagtcacggcgcaaccaacgcatattatcaatagtttagctgaatgggaagtttaaatgggaagtttaaacggcgtcaaaaaaacgggcaactggctagttttttatctcagtatcgttagtgggagtattctagcggcgattgttatcggttggttgagctatgacttggtaagccgacaacttcatttggcagcgcaaatgcagatgagccaggcgacgttaatgcacgagtttaaccgcttgatgcgttatttggttttgccgggtggacaatcgctagtgttgccacatttcaagatgtcagcaaatggcttggcgcattttaaggaagttaaacacctcttcttattaacggcggtcattttcctggtgacgattgtgccggcacttagaggctggcggcgtgattttaagtcggggaggcaatggcgctatattcgaccgatgcaagtcgcactggttatgccgattgtaattgggttgattgccagtgttagctttgatcgctttttcgtgttatttcatgaattgctatttcgcaacctcgactggcagtttgacccgctgttagatcccattattttagtgttacccgagcagtattttatgctgtgctttatctgcttttttgtcatcctcgaaggtctttttctgattattttgtggcgggcaaagaagtcattgaaaatttattaaatgacgcagttaattgattttgtgttacatatcgacgcgcatctggtcaatattgtcaatcagtttggcaattggacgtatgtgatcttgtttgcgattatttttgtagaaaccggggcagtcatcttaccgtttctaccgggggattcattattatttgccgcagctgctttagcggctcgaacagataatgatttgaatatctgggtatttgccgcattattcttagttgccgcaattgcgggggattctttaaacgaacaaattggtaaaagagttgggatggctgcaaccaagagccgtttcttcgggaagtttatcaataccgaaaagattgaagaggcccaggtcttctttaacaagtatggtggcaagacgattaccattggccgtttcatgccaattatcagaaccttcgtcccatttgtcgccggtggtagtcaaatgtcatttggcaagttcttccgttatgatgttatcgggagtgtcttgtgggtagtcctttgttgtggggccggctacttcttcggaaacatcgcagtcgtgaaggaacatttctcattggtcgttttaggcattattgccgtttcattaattccaatggtcatcaccgcggttaagagccaattaaagagccgaaaagctaaatcataattacataatagaagtactgtgaagtggttggcgcttttcagggtagagtttggttaaaagttcggtcacggcaaccggtgcttcaccaaagccgctcgcaattaacttcaccttaccaggataagtggcaatatcgccaatcgcatagacgtttggtaagttggttgccatttgttggttaacactgacttggtggtgatcaagcgttaagccccaatcacggagaatccgtgtatcggagataaaaccgtagttgacgagtaatttatcgacaaccagttgttcttgatcggttgatttcattttattgagtgaaagggcgagttgatgatcaacttctgtgagaccgtcaattaaaaatggtgtcttaatttgaatagaagagttcatcaaagcatcgacactgctttccagaccccggaactgatcacgacggtggatgatatagacttgtttggcgactttttcgagcatgagggcccaatcaatcgcagaatcgccaccaccagcaacggctacggtttgatctttaaactgtgccatttctttagcgaagtagtggatatagttattttcccattcaggttgataatcaacggctagttttcggggcgtaaaggcaccatttccgacggcaacaatcacaccgcgtgtatgcgtcgttcctttagatgtttctaagatgtaagtcccgtcttcttggggtaggatggccttaacagatgtttctaattgggttgtcggttcaaagacggctaattgttcagccaagttagcagtgagctgagcaccagtaatgcctttaaaaccggccacatcgaagatttctttttcaggatagagcgttgcgacttggccgcctagttcagggaggctctcgatgatttgcacatcggctttacgcatgcctgcgtagtaagcagcaaacatgccaacgggaccgccaccgattacggtaatatcaaaaagatggttaggatcaagcatatgacatttccacaattagatttagaaaactttgcaggaccaacagcaacttttgacaccaaccatggtgaattcactgttgcgctattcccagaacaagcgcctaagacggttgaaaacttcatcggcttagctgaaaaagattactatgacggtatcgtcttccatcgagtaattaacgacttcatgattcaaggtggcgatcctacaggtacaggtatgggtggcgaaagtttatggggccaagcttttggtgatgaatttagccaagaacttttcaacttaaatggtgctttatcgatggctaatgctggtcctaatacaaatggtagccaattctttatcgtgactaatgaacacatcaacccaagcatgatgtctcaaatgcctggtgctggctatcctgaagaagtgattgcagcttacgaaaaaggtggtacaccttggttagatcacaaacatactgtctttggccaagttttaagtggtatggacgttgttaatgaaattaatgctgttgaaacagggatgcaagacaaacctgttgatccagtggttatcaatcacatttcaatcaaacactaaatggtttatcgaattggacaaaaagtgacaggcaccgtaacaggaattcaaccgtatggtgtctttgtggcattagatgaatcagttcaaggcttgattcatatctcagagtgcggtcatggttttgtgaaggcgctagacgagcaatttacagtaggacagcaattagaggtattagtgttagatgttgatgaatacacgcataagattagtttgtcattacgtgcacttcataaggcacaggatctactaccacaacgagcaaagaagcattactggactaaccgtcggattcaaacaggttttgcaccgattgcggagcgattaccgggatggactaaagcggcaattgaagaattaaaccaaaggggtaaatagatgagtgctaaagtagcaggaacaatcatgtacaagacaaagcaaggtcaatatgattttttagtgcaaaaacaagccgatacggattataaaatgttatcaacacataaaaattcggatcaaacaccattagctgcagttttaaatgccattaaagcgacgattaaaattgatgttaatgagctaagattgattaatttagctaatattaaccttgaaggtgagaatgtttcgttttttgtctttcaatggagtgaacatccggccgaattctatgacgaacaattgcaaataattgcagaatcgggctatcagttcgcaaatcctagtgaaatcacggaattgcttgataaactggaagtaacaggcgttccacacctaaattaaatgaagaagtggggctttttacttagcggtggttttttactggtcattattttaagcatattactgattaatcagcgttcaaatcaagcacgacagcaggctaatcgtgttcgtgacagcgcaccgaccttttatttacatgggtatggtggttccggtcgctctagcgatagcatgattgaggccgcagaagagcggggcagagcgactaaagtgttaacggcaattgtcagtcgtactggacaagttgcgttagagggacattggacagatagtactacccggcccattattcaggttatttataaaaataatcggaatccgaattatcggcaaaatggtgaatggtttaaacgggtattgattgcggtcaatcgacaacatcattttaagcagttcaatgttgtcgctcactcgatgggcaatttaacgttagccttctacctagccaataatgcccaaaacaaaaaaatgccgcagttagctaaatttgtttcaattgcaggtcattatgctggtattatcggaatggatgatcgtgctaatcaaaatcatttagctaaagatggtcgcccgcagcagattaacgctacttatcggcaattaatgggattaaggcatagattgccaaaaaatcaggttcaattcttaaatgtttatggggacctatccgatggtagtgattctgacggacgcgtcagcaatgtctcttcgcaatcgttacgatatttagtggcgccaagggctaaatcatatcgtgaggttgaatttaagggacgtaaagcacaacatagtcagctacatgaaaacgaggctgttaataaaacggtgatcgattttctatggtaattataagttggtgtcgctgttttgttgttcaagacggtattctttagcagcggttgttaaagtccctaataaggcttgttgagtcgctgagaagagttgtgtcttgcgataagctaatgagatataaaaggttggttgcggttgatcaagtaagtctaaaacaataagatcatcagctggtgtgatggccgtttcagttaaaaaaccgactccgacattttcatggaccatacttttgaggatgctcacgtcattggtttgataaataatgtcagggttcatttggttcatcgtcgaaagcgtatcaaagacgacggggtggacgaagccctctgccaacataatgaagttttcgttggctaaatcacgaaaggcaacctttttagcggttgctagcggtgatttggggctgacgacgattttgaagtgatgttgctcgataatctcagccgttagcgcatcattttctaatggggttgcagagccaagtagggcagcatccaaacgtccagcttctagactagctaataattcagtagaaccaccatcaactgtcgcaaaatgttgaatactcccagccttgactaatttctgcgctaatttagagaagtagtaggtgccgataatcggcggaagtccaaaacgaagctcagttgcagagagattttgcatatcattagttgttaattgaatttcatttagaatgttgacagcgtgtcgattgagttgttcaccgctatccgtaataataattgattgatgggactggtcgcggcgaattaatttagtgtcgaattcttcttctaagcgcttgaccgcataggtgattgttggttggctgacaccaaattgatcggcaactgctgtaaaattttttaatttaattaaagcgacaaaatattctaaatctttaatcttcatatgaaagcacaacaaattttaaatgatccatttttaaataaaggcacagcattcactgctgaagaacgtgcacaatttggtttaacggggatgttaccacctcacgttcaaacaattgatgatcaagttaaacaagcttatgcacaatatcaatcaaaagctaatatgttagaacaacgtattttcttaatgtcaatttttaacgaaaaccgcgttttattctacaagttattcagccaacacgttgctgaattcatgccagttgtttacgatccaacgatcgctgacacaatcgaaaactacagtgctttatatgttaacccacaacacgcagcattcttatcaatcgacgatcctgattcaatgaagacaacattggcaaatgctgctgatggtcgcgaaattaaattaatcgttgtgactgatggcgaaggtattttagggattggtgactggggtacacaaggtgtcgatatctcagttggtaaattaatggtttatacagctgctgcagggattgatcctagccaagtattgccagttgttttagatgctggtacaaaccgtgaaagcttattaaatgatgaattatacttaggaaaccgtcatgaacgtgttcgcggcgatcgttactacgatttcgttgatcaattcgttcaaaccgctgaagaattattccctaacatgtatcttcactttgaagattttggccgtagcaatgctgctaacatcttgaacaagtacaaagatcaaatcgttactttcaatgatgatatccaaggtacagggattatcacattagctggtatcatgggtgctttaaatatttctggtggcaagatgacagaccaagtttacatgagctttggtgctggtactgccggtgctggtattacacaccggatcttcgaagaaatgttacaagaaggtttaactgaagaacaagcacgtagccgtttctacatggttgacaagcaaggtctattgttcgatgatgatccagagttaacaccagaacaaaaaccatttgctcgcaaacgtagtgaattcgctaatgctgatgaattaacaacattagaagctgctatgaaagcaatccacccaacaatcttggttggtacttcaacacaacctggtacatttacagaatcaatcgtgaaggaaatggccgctcacacagaacgtccaattatcttcccattatcaaacccaactaaattagctgaagcaactgctgaagacttaattaaatggactgatggtaaagccttagttgctactggtattcctgccgcacctgttgaatacaacggtgtcacatacgaaattggtcaagcaaacaacgctttagtatacccaggtcttggtttagggacaatcgcttcaactgcaaaagtcttaaatgacgaaatgatcagtaaggcagctcactcattgggtggtatcgttgacccaacagaagccggcgcagccgtattgcctcctgttacaaaattagatatcttctcacaaactgttgcgacagctgttgcacaaagcgctgttgaccaaggtttgaataaagaagaaattactgacgtgcaaaaagccgttgcagacatgaaatgggaaccagaatacaaagcactataattggcagcatttctaacatcattatcaagtgtcgtcgaaatcgtcttagtcattgctttggggttttggctacggagttctaaaaagttcgatgataactttaagggtacaatttcatttttaatcatgaacgttgctttaccattatcaattttcgtttcagttctagataacttaacacgtgaaaagttggtcggtttatctggcggcttaatctacgttttaattagtttcgccctaggttacttagttgcttggttattaacaaaggctttccggattcgtccaggtcgtcgtgggacatttatcaatatgttcgttaatgccaatacaatcttcattggtttaccattgaacttggcactattcggtgacaagagtttaccttacttcttgatctactatgttgctaacactgtttcaacatgggcaatcggtgtcttcttcatctcaaatgatgatcctacaaaagaaaaaggcgctgctaaaggcaaatttaactggcgtaaattattaccttctccattaatcggtttcttagccgcattaatttatcttttaactggtttaccattgccagaacttgttgataagacattctcaatggttggtgggatcgttacaccaatgtcattgatctacattgggattatcttagctgatgctggtttgaaatcaatccatttcgaccgcgatacaatcttagccctattaggtcgcttcgttgttgcaccagcaatcatgattgcgattatgatgttcttcaagaatacaacttcaattccaacaattgaacaaagcacattaattattcaagccgcaacaccaggtttggctgtcttaccaatcttagtcggtcaatcacacggggacgttgaatatgcaacaaacgtcgttacaacaagtactgtcttgttcgtcgtcgttgtgcctatcttaatgcaaatcgttcaattcatctagatgtcagaaaagatttatacgaaacaagcgccagaaccattaggaccatacagccaagcaattgcaacggataagattgtctttatgtcaggtcaactggggttaaaagacggcaaactcgcacctgatttagcagggcaaacgaaacaagccattatgaacttacaaagtgttttaaaagaagctggcttaagtttagaaaatatcgttaaaaccaactgcttcttaaccaacctagatgactttaatgaatttaatcaagtttatgcagaatttttcggcgacattgcacctgctagaagtgctgttcaagtcggcaaactaccagctggtgggattgttgaaattgaagccatcgctgttcgataaatgaataaagtagccattatcggtattggtcatgttgggagtacagttgcctatacgcttgtttcccggcgcatttgtagtgaattagttttatttgaccaaaagccaaaattagcagaagcggaacgaaacgatttagaagccggtcaagttgatcatacaggatttgttaagattacagctaatgatgaaagtcaattagccacttgtgacctagtcattttctcagctggtgacattagtatccttgaacatagtgctgatcggtttgatgaattaacttatacgaaaacagcagtcgcacaatgggcacctaaattaaaggccgctaatttcaaaggaatcttattgaacatcactaatccatgtgatgtaattacccaatatctacaagctttaactggctttcctaaggaacgcgtattaggaactggaacgactttggatacagcccggatgcaagttgcagtcggccattatttgaacgttgcgcctaatagtgtgcacggctatgtgctaggtgaacatggtaattcacaatttgtcgcttggtctggggtgcatgttggtgggcaaccactagcaacccaattatcaccagaacaattggcacaatttgaagttgacgctcgccaaggtgcttgggaaatcctcagcggcaagggctatacgtcttatgggattgctaatcaagcagcgcattgtgctgcagctatcttacaaaatacgcgccaagtcttacccgtttctaactttgatgacactgtacaatgctatgttggccatccagctatggttggtgccgcaggtgtcttacaggattatccaagtcagttaacgacagcagaacaacaaaaatggcaaacatcgattgatacgatcaaacacatgtatgccgctatctaattaaaatagttgtcccaagaggaacatcatgagcggcaccatcaacaaagccccgagcgttgtctcggtcaccatgacagcggcaaaatcagcgtctgtattataaagtcgtgcgacaactggtgcatttgtcataacgggcatacaggattgcagaatgaagacttgtttcatgaggggtggcatgtgacttggatagactaacgcagtcattaataaaggcgcaaagatgaaccggccggctaagacacctagttgatctttgccaaagcgaatatttttgagtccggcattataaattgaaatcccaatgaagagcatggatagtggggtggtcaggttgcctagataagtgaaggactgtgttaagaaactgggtaagtgccaatctaataagaccaggataacgccgataataaaaccgattagtggcgccgagaaaaccttctgtaaaacagttttaagggataaaccctcttgattggcaccatctcgttgaattaagtaaacgccaagtgtccaaaaaatggtggtattagccatgtaatagactaagacaaagggcagactgcgctgaccaaagagggccaggttaattggtaagcctacaaaaaccgtattggagttgaagaacatggattcaaacaagccacgccgactggcatcgactttaatgaggcgtgcgacaataattgaaatcccaaacaagagtaacatggagagcactggaaaacggaggttgggaagtaaggtggctaactgatcgtgtgaaaagtctttggtgattgaaatgatcatataaggtggtagagcaacttgtgtgacaagtttagcgataagcgctgtgctatcctcattaaaccaatgacgtgcggctaaggcatagccaaccgcaatcataataatgataataaaaacaccggcactactattaactaaggtttgcatttgattttaactgaaacaacattagcaggaattcattttgataattgtttaatgaatgcagcaggcgtttattgttatgacgcagacgaactaaatcagattcaaaaatctgcagcaggcacttttgtaacgaagagtgctaccgtggtcccaagggcggggaatccagaaccacgctatttatcaacaccttgggggagcattaattcgatgggacttcctaataagggattaccctattatctcgactatgtttctcaacaacagaccctctttcctgaaaaacgatattttcaatcgattactggatttaatatcgatgaagacgaagcgcttttgaaacagattacggattctgattttaatggcttagtggagttaaacctttcttgccctaatgtgccgggcaaaccacaaacgggttatgattttgaaacagttgaacaaattttaacacgggtgtttgaagtgtatgaaggaccactaggggttaaattaccaccttattttgatattgttcattttgatcaaatggccgccattttaaaccaattcccattggcattcattaattctgtcaacagcatcggtaacggcctcacgattgacgctgctaccgaacgggtcagcattaaacctaagcatggttttggcggtattggtggtgattatattaagccaacagccctcgcgaatgtccacgccttttaccaacggttgaaacccgagatccaaattatcggcactggcggtgttaagtctggtcaagatgtttttgaacatctattatgtggtgctagcatggttcaagtcgggacggcacttcacaaagaaggcccacagatctttgaccgcttaacggcagaactacaaacaatcatgcaacaaaaagggtataataaaatagctgattttaaaggcaaattaaaatatttagattaaatgcaatataaacatttatttttcgacatggacaataccttatttgacttcgatgcggatgaggaccaagcattagagcggctatttaacgcacaagacatcgacttaacgagtgatattaaaacaacttatcaaacgttcaaccaaggattgtggcgtcaatatgaacaaggggaattaacccgggaaatattattgaacacccgttttgcgacttttttcaaaaaacagtttaataaagtggtcgatggtcaacaattatcaagccaatatttagataatttggcattagggcacgatttaatgccacaatcagaagagttattagctgggttacaagcacaacacgccaaattatatatcacaacgaatggtgtggcgcgtacgcaataccaacgactacaagactcagggttggcccattatttcgatgctattttcgtatcagaagaattaggctatcaaaaaccggacccagcttattttcaaactgtttttcagaaattagaaactgtcccaatgacccagtcattgatcgtaggggattcactgacttctgatgttcaggggggccaaaacgtgggtgtggcaacagcttggtacaacccaacagggcaaatcaatcatgatcgggctttacagccaacacatgagatcaaacaattaacagaactattgacgctttaaatgaaaaagcaacgttattttagaattagtttaggctggcggattttaatcgggattgcactaggattagttgccggtgggattttctaccaaaacaaaactgcaattgcggtgatgcaagcgatagggacgttgtttattaatttaattaagatgattgtattaccaatcgttgtttcttgcttggtagtcgggatcgctaaaatgggcgatatcaagaagttgggtcgaattggtggcaagacgcttttgtattttgaaatgatgaccaccattgcgattgcattaggattgacggtcggtaacttgacgaaacctggcgcgttaatcaacatccatagtttgagccaaggatcaattggtcaatatacagctgctgctaaatcagctagcaatcatggtttgggcgatattattatgaatattgtaccgactaacatttttaaggcgcttagtgaaggggatatgattccaattatcttctttacggtcttgtttggtttaggacttgcaacatttggcaaacgcagtgaaccgctcattaacgcttttgaaatgatttcagaagtaatgttcaaactaactaactggattatgcaattagcaccaattggggtttttgccttaatcggtgtgacgattgcccaatttggtttcgatgcattgaagcctttggtttatttcttagtcatttgctacttaacgatgattttcttcgtcgtcgttgtggcggggctagtggcacgaatctggcatattaatatcttggaattattgaaagtcttcaaagaagaattagtgctatctttttcaacagccagttcagaagctgcattacctaaagtaatggaaaaaattcaagattacggtgtgagccaaggaattgcttcttttgtcattccaaccggttatacatttaatcttgatggttccgcaatctatcaatcattagcagcgctctttttggcgcaagcttaccacattcatctcagtctaatgcaacaactaacactattggtggtcttgatgattacgtctaaagggatggccggtgtacctggggcttcatttgtggtattacttgcaaccattacaacaatcggagtaccagctgctggtgtggcctttattgctgggattgatcggttagtcgacatgggccggactgccgtcaatgtgatgggaaactcattagcagccgtgattatcgctaaatctgaaaacgaatttgacgaaacaaaacgaacgaaatacttagcgcaattaagtgctaaaaaataaatggttggaatcgttattgcaagtcacggggagtttgctaaaggtatcatgcaatctggttcaatgatttttggcgaacaagaaaaagtacaagctgttacttttatgcctaatgaaggaccggatgatttgaaagcgcatttagaagctgccgttgcaacgtttgacgcagatgatgacgtcttgttcttagtcgatctttggggaggttcaccatttaatcaagcaaatggcttgttcgaagctcataaagataaatgggcaatcgttactggtttgaacttaccaatgttgattgaagcatacgcatcacgtttatctatgacatctgctcatgaaatcgcagcacatattattgatgaagctaaggctggtgttcgggttaaacctgaagacttagaaccaaaagaagcaccaaaggcagaagcaaaacaagctgctaatacaggtactcctggtaagttcaaatatgtcttggcacgtattgattcacgtctattacatggtcaagtggcaacaacttggtctaagacaactaacccaacacggattattgttgtttcagacaacgttgctaaagatgaattacggacaaacttaattaagcaagctgctcctggtggcattaaagcgcatgttgtgccaatcgatcaaatgatcaagttggcaaaggatgatcaacattttggtaaggaacgtgctttattattattcgaatcaccacaagatgcactcagagccgttgaaggtggcgtaccattagaaacaattaacgttggttcaatggcccactcaactggtaaagtacaacctaatactgttttggcctttgaccaagatgatatcgatacatttgaaaaactaaaggaaaagggcatcaagtttgatgttcgtaaggttccaagtgattcaaacggtaatatggatagcatccttaaaaaggcacaatcagaattagacaaacaaaacaataaataaatggatttgaatttcattcaagtgattttggtcatttttgttgcatttctagctggtgtggaaggtatcttagatcaattccatttccatcaaccagtaattgcttgtacattaatcggccttgtaaccggtaacttattaccatgtcttatcttaggcgggacattacaaatgatcgccttaggttgggctaacgttggtgccgctgttgcacccgatgctgctttagcatcaatcgcatctgcaattattttagtacttggtggccaaggcaaagccggcgtcacatcagctatcgctattgctgtacctcttgcagtagctggtttattattaacaatcatcgtacggacattagcaacaggtatcgtgcacatcatggatgctgctgctaaagaaggtaacttccgtaagatcgaaatgtggcaatacatcgctattatcatgcaaggtgttcgtatcgctattcctgcaggcttaatcttagcaatcggtgctggccctgttaaagaaatgttgacagcaatgccagtatggttaacagatggtttagcaatcggtggtgggatggttgttgctgttggttacgcaatggttatcaacatgatggcaactaaagaagtatggccattcttcgcaattggtttcgtacttgcaactatctctcaattgacacttatcggacttggcgcaatcggtatttcactcgctcttatctacttagccctttcaaaacaaggctcaggtaataacggcggtggctcaaatactggtgatccgctaggcgatatcattgacaactactaaatggcagaacaactaaaattaacaaaaaaagatcgtatctctgtttggttacgttcaactttccttcaaggttcttggaattatgaacgtatgcaaaatggtggttgggcttatacattaatcccagcacttaagaagttatataagactaaagaagatcgttcagcagctttagttcgtcacatggaattctttaatactcatccttatgttgctgcaccaattcttggggttactttagctcttgaagaagaacgtgctaatggtgcaccaattgatgatgttacgattcaaggggttaaagttggtatgatgggacctttagctggtatcggcgatcccgttttctggtttactgttaaaccaattatcggtgctttagctgcttcacttgctatgagtggtaacattcttggcccaatcatttatttcgttgcatggaatgccatccgtatggcatttacatggtacacacaagaattcggctaccgtgctggttctaagattactgaagatttatctggtggtattttacaagatattactaagggtgcttcaatccttgggatgttcatcttgggatcactggttaatagatgggtatcagttaagttcacaccaactgtctcatctgttaaattagataagggtgctttcatcgattgggataaattaccaagtggtgctaaaggcattcaatctgcattacaacaacaagcacaaggcttgtcattgacagatcataagattacaactttacaagataacttagatagcttgattcctggtttagctgcattaggtttaacattattctgtatgtggttacttaagaagaaagtatcaccaatcgttattattcttggcttattcgtagtcggaattgttttccatctattacacttaatgtaaatggttcaatcaattaatacaaaggtcgaattagtgatcaatgcgacctcttttactgcgttaacagattacggcaaaatcatgattggcgataagggctttgaattcttcaatgatcgtgacgcccgtcagtttattcaaattccgtgggaagaagttgattacgtgattgcttctgtcatgttcaaaggcaaatggattcctcggtacgcaattcagaccaagaaaaacgggacctatacttttgcttcaaaggaacctaagaaagtgttacgcgctatcagagaacacgtaccagctgaaagattagtacaatcactcggtgtgtgggatgttattaaacgggtttttacgcgccgcgcaaaataaatgggattcgataaagcgattattgcgttaaaagcaggcaaaaaagtagtgcggacaggctggggtggtccagaactattcatcgttcaagttagtggcgacacgtaccaaggagaaacaatcagtccatacctattgattaaaacgactgaagaaccagcttattcaatgttccaaccaacttcttgtgatgtattagccgaagattggcagttagttgattaaatgggtcattttgcggatttaaaacaaaagacggttttagtcactggcgccgcttccggtattggcaaggcccaaatgctagcttttttggcggagggtgcgatggttattgcattagataaggcgccgattacgcagacggcagacggtttaaaaacggtacaagtcgatattcgggacgctccccaattaacggcaacgttaaaaaatttgttagcgacagtgtcgtcatttgatattgtctgtaatacagcgggcatattggaccaatacacaccaacgcttgaaacaagtgaggctgattgggataatctgatggcggtcaatttgaaaagccagtttttagtgactaatgcggtactaccaagtatgctagctcgccacgaaggcgtttttgttaacatggcttcaattgccggattagtggctggcggcggcggtgcggcctatacggcttctaagcatgcgattatcggttatactaagcagctggattacgattacgcaagccaaggtattcgggcgaattgcatcgcaccaggcgcaattgaaacaccgatgaacgctgccgattttgcgggcgctggtgaaatggccaaagaggtggcgcgtcaaacgccagctggtcgctgggcacaaccggcagaggttgctcagttaagtttgtatttagcaagtcaagcctctgattacatccacggaaccgtggtaccaatcgatggtggttggcttgaaaaataaatggcaaaacaaattaaacttagtcaaacggtttatgagttagtgactgcatatccagagattgtccccgtactcgtttcaatcgggttggacggtgtgacgaatcctgcattattgaacacagcagggcggtttatgacgttacccaaaggtgcgcagatgaagcagatcccactttcacaaatcgtggcaactttgacagaaaatgacttcgaggtgattgcggatgactgaatgactgatcaacatagcagtgcgtaccggcaaaaaagaattgtcgaaattttaaagatgttacataacggcggatctttcgaggaagctaagcggattttcgatgaatcattttcaggggtcgatgtgtccgagattacgtctgctgagcgggaattaattgccagtggcttaaatcccatggaaattcagcatttgtgcaacgttcatgcggccgtttttaagggtgcaattaaccctaacggtgctgaaacaccagcacaagaacaaccggggcacccagtcgctgttttgaaattggaaaatttagtgatcaattcgttattagtggatgaattgttaccttgtcttaagaaatggcaacaatcgggttcagatcaagcttacttaaaccgaatgcaacaagcgctaaaagatttattgacgattgatcggcattattcacgcaaggaaaatctgttatttccattaatggataaatatggcatcactgcgccaccaaaagtgatgtggggcgttgatgatcaaattcggggtttggtgaagaccgtctatcaaatggtgatcagtgaaccggttcctgataaatatgaagttgaagcggccattgaaaaaatgaccaaggaaatccaagaaatgatctttaaagaagaagaaatcatggtgccaatggtcaatgaagtctttacgccagcggattggggcttgatggcagatgaaagtcaaccaattggctatacattgattcctgagccacttccttggcaaccgagtcaggctgatttagaggcttcagaacagcgggcagtaccagctatcgccaaggaattaaatgcgatggcgcaatctttagcagataagcaggcaccggttagtcgagtgctaccagaagtaaagacgacacccactaaattagaggcggctagccaaatcccctttgccattcaggggacacctgttgaaacacctgtaacacaagcaactgcggctgaacctaagtcagcagagatgcctgattttgtgaaggcgatgttggcggataaggcgccggctgagaagcggcctgctaaagtgagtcgaaatcgggaagcccctcaaccgcatatcgagattggaactgacaaccaggcaacaattgtattgccttcagggacaatgaacttgagtgagctcacggcaattctacaagttttaccacttgatttaacgttcgtcgatcaagacgatatcgtgcggtggttctctgataataatcaccgtattttcccaagaacgcgggcggtcctcggccgagcagttgttaactgtcatccaccaaagagtgtggataaagttgaaaagattttagccgattttcatgctggaactgaggatcacgccgatttttggattaacttccgcggcaaattagtgtatattagatatttcgcagttagagatccacaacaacggtatctgggttgtttagaagtcagtcaagatattaccgagattcaagcactaacaggcgagaagcgcttgtagatgcaacagattatattattattggcggtggggattttagccggtattttaggtgcgattctcggcattggtggcgggattatcctgacacccgttttaacactcgcaattggtttagacatcaagtacgcaatcggagctagtattgtcgccgtgattgccactagttctggtgcgacaattgcttatttaaaagacgatatgctgaatttacgggtggcaatgtttctagaaattgcgacaaccgtgggggcgattatcggggcgctattaaccggcgtcgtaccaaccggctttttattcattttgtttgggagcttcctattattctcaacttacaatatgattcaaaaactgcgtggtaaaaaggccgaagaacatgttggtgcagctaatgatcagtgggctgaaaagttgaatttaaatggcacttattacgataaggccaatcaaaaacaagttgattaccaagttgaaaaagtacctggtggttttgcgatgatgtttggcgccgggattgcctctggtttattagggattggtagtggagtcttcaaagtcactgcaatggataccattatgaagatgcctttaaaaccatctagtgcaacaagtaatctaatgatgggtgtgacggcagcggcttcagcaacagtttatttctttagtggtgcgatcctaccagaaattgccgcaccgttagcgcttggtattttagcgggcgcaacagttggttcaagaattatgcaacatttgcaaccgaagtttattcggatgatttttattccgattttactgtatatgggcttacaaatggtgcttaaaggattcggggtgcacatctaaatgacagatcgtaaaaaagaaatggcgcaaattgaattagtaattggtaaaatcttacgggttggtgttttggtgtcagcaaccgttctaattatcgggatgattttattcttaatgcatggtggcacaggttatggcgaacaccaatttccaacaacctttgctatgatttttcaagggatggctgaattgaaagccggcgcggtcatcatgtttggtttattctgcttgattttaacacctgttttacgggttgtagtgtcaatctatgcctttgcaaaagaagaagactatctatatgtctggattacggtcattgttttggtgattttaatcattgggatgacgattgggtttatcaaataattattgatcttctaaacctaaaatgcgctttttcttttcttcaaattcgtcgtcggtcatcaggccgtcttctttcatcttgaggtaggccatgattagttcgccttttttgacgaaacttaaatcttcttcagctggcttttcgatgtaatcgttcatcagttgatagagtttttgcaagtcatcgttatcagcggcctcaaagctgatgataattttttcgagggcgtggttgggtttttgatagagaatttggagatgcccttgccggtaagtggcttcaaaaaaacgaacggattttaattttttaaaggcaatctcacgatcgtctttgtcatttttctttaagagtcctgggtagtgaagtgtgagaatttgatcatcataagtgatttcaagtttgcgtggcttcttaatgcgataagtctgcatatgcaatttttcactggtattcgtaatggcttattactcgcgttacccatctggggcgtgttaatcttagtaatgagcagctggttatattaattgaatattggaatatttacggacacctactttccacaagtcagcggtgtggcaacctccattaaaactttaaaagaggggctcgagaaaaaggggcactctgtttacatatttacaacaactgatccacatgttgataaagaaacaattgaaccgaacattttccgatttgcaagtgtgccgtttgtgtcatttacggaccggcgaattgctgttcggggcctttttcatgcctatcaggttgctaaagaattagatttagatatcgttcatacgcaaactgaattttcgatgggttacatcggtaagtttgttgctaagaacttgaagattccgtgtctgcacacgtatcacacgatgtatgaggattatttacattatgtgttaaacgggaagctcttgcgtccttatcacgttaaacagatgagtaaggcctttttatatcacatgtcggggattgtggcaccgtccgaacgggtgtcacagacgttgaatcgttaccaggtcaaagcgccgattcggattattccaaccggggtcgatattagccggtacgaaaaacaagtgaccttggatgtacgggaatcactaggtctaacgaaagaacaacccgtattgttatcactcagtcgggtcgcttatgaaaaacggatcgatgttattatcgatgcgctaccacgcttggtggcgcagaaaccagatttaatgttggttattgctggtgaaggtcccgcgcgtgaagacttggaagcacaagtcgctagattagggatgagcgaacacgttatttttaccggtatgattgataacgatgatgtttctaattactatcacatggcagatttattcgtttcagcgagtgattccgagtcacaagggctaacgtatattgaagcaatggccgctgaagtcaaaattgttgtgatggccagtccctatgccagtgaattattgacggatccgtcaattgggacgacttttacaaccgaagatgaaatgttgcatcaaatcttgaactatttgaatcatccgggggcttttgatgacccagcaccacggcaaaataagttgcacgcgatatcggcagattattttgcggaacaaatggttcaattttataagcaatcacaagtgttatacgatgaactgaaactagatcaagatgagttgttagaattagaagatatggatactaaaaaataaatgagtcgaacaaataaaattgtttttgcagtcatgttagcgattggctgcggcatattcgcttatgagagtcgcacgttacagttaaatcaattggtggcagatattagccggttaaaagtcggctggctactagtcgcacttttatgtatgttagtttcttggttctttgaagcattagtactgcgcgtctttttaaaggggcggacgacggatttttcattattcaacgccttgcggattccattgattgcgcagctctttaacgcgattacgccattttcttctgggggtcaacctgcacaactagtcgcactgatgcagtcacgagtggaagcgggccaggcgagttccgttttattaatgaaattcatcgtctatcagttcatggtgttggtcaacttcctattaagtatggtcatcggcttttcacaggtttccaagcactttggcacgctggcgattttaattaactttggtttgattgtccacgtcgttgttctagcggtcttattattggtgatgtactacaataaatttactaagcaattggtacattggttgttaattccggttagctggttcgtttccaaaaagcggatggctgaatggcgtggtatcctgttaactaaaattgatacgttttatgccgagagtctccatctcaaaaaggaaaagaagaaactcatcaaaggctgtttattaacgctatgccaactctttttctactatagtgtgccgtacttcgtgttattggcgttaggtagtccgaatgtgaattacttagaagtcatggttttacacgtcatgatcgtcatgattgtatcgctcttcccagttccaggtggttctggtggtgcggaatacagtttcaagactttatttgccacctttacgctgagttcgagtaaactggtattagccatgttgttatggcgacttttcacttattatctaggaatgtttatggggattggcgctttagcggtcaaacccaagttaagtgctaaaaaatagatgcaaccaacaatcggttttatcggtatcggtgtaatggggagcagtatggttaaaaatctattgaaagcaaactactcagttgtcgtttacaatcgaacgaaacaaaaggcagatgaagttgtcagtttaggtgctaagtgggcggacacaccagcagctgtcacggcacaaagtgatgttgtcttatcaatggttggttatccacaagatgtggaagcaatttattatggggatgacggtatttttagtgcggtcacgccagataaaattgtcgtggatatgacaactagtacaccaactttggcgcaaaaatttgcggccacagccagtgaattagggttacaagcattagatgcacccgtttcaggtggcgacatcggtgctcaaaatgggacgctaacggtgatggtcggtggtaatcaagccgcttacgaacaagttaagcccgtttttgaagcagttgggcaaaccgtacaacgtttcggcgaagccggtaagggtcaacacactaagatggctaatcaaattatgattgccggcacaatgactgggatgactgaaatgttggtttatgctcaggcggccggcctagatttaccagctgttttaaaaaccgtcaatggtgggagtgctcaaaattggagtctcgcaaattatggtcctcggattctagcgggcgattacacacctggcttttttgcaaaacatttcttgaaggatttgaagattgccttagaagaatctgagaaaatggggcttaatttaccagccacacatcaagccaagaaattatacgcaagattagtgaatgaagcgggccttggcgatgatgggacacaagccttgattaaattatggacagattctataaaataaatgcaatcatcacagttagttgcgattatcaaacgtctggtagcaatgcaagaagatcaaagcgctgaggttcaagaaagacgttttgaaaaggaaggcgatttaaaagcgactgttagctatgatccacaagcacaagcctttgaacttgaagacagtagcacacatcaacaattccaatttgacaatattgatttagtcgcaatggaactatacgatttattagcagactagatgaaacagattggtcataaaattcaggccggattgagtacgcgctggggctttttcctatttgcggtggctttattctggcttaaaacgatttatgcgtatcaaacgaaatttaacttgggtgtcaaaggtggtatgcaagccttcttaatgacgattaaccccattccaacaaccttattgttatttgggattgcgctatttatgaatggccgcaaatcatacataacgttgatgattatcgatttattaacgtcagtctggttgttttcgaatattctctattaccgagaattttctgattttttaacctttaacttaatgaagggctcaggcgctgtttctaataacctgggtaagagtattgccggcattattgaatattccgatttcttagtttttgcggatgtgctgttattattaatcttattagcgactaaactaattaagattgatcggcgtgttttcatgaaacggaatgcttttgcgattactggattatcagtcgttttattcggcgctaacctggggatggctgaagcggatcgttctggattattaacccggacatttgataataactatattgttaaatacttagggatgaatgcctacacggtttacgatggtgttaagactactaagaataacgcgattaaggctaacgctgatagtagtaatatgagcggcgtcttgaaatatttaaaagaaaaccgcgtgtcacccaatgttgaatacacaggggttgctaaaggtaagaacgtctttgtcattcatttggaaagtttccaacaattcttgattgactacaagtgggatggccaagaggtcacaccaaatatcaataagctttatcatgatcaaaacacattaagctttgataacttctttaaccaagttgggcaagggaagactgctgatgccgaattaatgcttgaaaactcgttattcggtttacctgaaggggccgccatggttacacaggggacaaccaatactttccaagcagcaccagcgattttaaatcaacaaggttacacaaccgcatcattccatggggatgtcccaagtttctggaaccgggataatacctacaagtcatggggctatgattatttctttagctcacagtactttaaagaaggtaaggattacaatgttggctatggtttgaaggataagatcttcatgcaagattcagcccgctatattgaacaattaccacaaccattctatgcaaaattaatcacagttacgaaccactatccatacttattggataagaagaaccaatcgattgctaaaaccgatactggtgatgataccgtcgatggctatgttcaaacggctaagtatttagatcaagcactaggcgaattcatgacctggttacaaaagacaggcctggataagaatagtatgttggtcttatacggggatcattacggtatttctgggaatcataagaaggccgttgccaagttattgaagaaggatgaattcaacgactttgataacgctcagttccaacgggtaccatttatggtccatatgccaggcttaaaaggtggcgttaaccatacttatggtggcgaaatcgatgtcttaccaaccttattaaatctcttaggcgttaagaacacggatacgatccaatttggatctgatctcctagcggctaaccgtaatcaaaccgtggtctttagaaatggggattacgtggcaccagattacacgaaggtcggcagtacttactacgatacaaagacgggtaaggaattgactaagatgaccaaagcgcaaaaactccgtgtcttagcgcttagtgaacacgttacaaaggaactctcattgtctgataaggtgattaccggtgatttacttcgtttctatacgccaacaggctttgaagcaactgataaaacgaagttaagctataaggtcagtgatgctaaagcacaactgaaagctgataagactaaaacgagtgttatccaaaagaataatggtaaatcgacgatgaatctctatcaaacagatgcacctgaattgaaataaatgagtcaaacaattgtggatcagacgcttcggaagttgaaagctaataatgtacgaattacaccgcaaagacaggctgttttagaatttatgattggcacgcacatgcatccaaccgctgatgatgtttatcaggccttagcaggacgctttcctaatatgagtgttgcgacgatttataataatttgcggttatttacagaactgggtgttatagaagaaatgacttacggggatgcttcgagtcattttgattttgcgcagaccaaacattaccatgcaatctgtgatcgttgtgggaaagtggttgatattttttacccaggactagaagatgttgagatagttgcccagaacttaaccggttttatggtgacgggtcatcggatggaagttcatggcatctgtccagaatgtcagttagccaatcgctaattatagaaataaaccagtaataaaaatgagataataaagctcatgtaaataagtattatttttaatgaaacccagttgcgttgctagcaacaatagttgagcaataataaaaggcaataattgccagcctacgatgattttagtcgcaatgatcaaaagaacggtgattaaccagaggcagtcaccaacaacggtgagcatcttattagttggaatcagttcaaaaaggaaaattaaccctaagaagagaccaatcttgacgagcaaggcttcaggtaagaaatgaatgccattgaaaatcaaagttgccaggaaaaagtaaggcgctaataaaaactgacaaactaatcgcaaccaatgattgttaaactgttttggaaagataaacggcacaagtaccaataaactggtaatcgctagtaaagtaccggcccaaatgagtgaatgacgaccaacaattagactaatgatcaacgcaattagcaggccgctagcggctaatgaacgctttagcttactagttgttgaaagaactagcggaatggttaataatgcccctaaaagtgcggttagcatgaagtataaatcaagatgcttgggaaaagggtgaatcgctaatcccacaattaagcccaggtttaagtagttaaatacgattaaccgagcaggcggattattagcaggtagttttttttgtctaagatagaacatatgcaagaaagacatttatttacttcggaatccgtttctgaaggccatccagataagattgcggatcaaattagtgatgccatcttagatgcgatgttagaacaagatccacaagcccgtgttgcttgtgagacaactgttacaactggattagtattagtcgtaggtgaaatttcaacaacggcttacgttgatatccaaaaggttgtcagagaaacaatcaagaagattggttatcgtgatggccaatacggttttgatggcgacaattgtgccgtgattgtagcacttgatgaacaatcaccagatattgcacaaggtgtcgatgattcacttgaatcacgtgagaaggatgaagatccgctcgataagattggtgcaggggatcaggggttaatgtttggctttgctgtcgatcaaacacctgaattaatgccattaccaatcgctttatcacatcgcttgatgcgtaaggtcgctgaactacgtaagagtggtcagttaacttatctacgaccagacgcaaaagcacaagtcactgttgaatatgatgaaaacgaacaaccaaaacgtgttgataccgtcgtcattagtacacaacacgatgaggatgttactttagaaaccattcaaaaggacatgctagaacaagttattaaaactgtcattcctgctgaatatttggatgataagacaaaatacttcattaatccaactggtcgcttcgtcattggtgggccacaaggggattccggtttaactggtcggaagattattgtggatacttatggtggttatgcccgtcatggtggcggtgcattctctggtaaggacgcaactaaggttgatcgttctgctagttatgcagcccgttatattgctaagaatattgttgccgctggtttagcacgtaaatgtgaagtgcaactagcctacgcaattggtgtggcacaaccggtatccgtttcagtaaatacttttgaaactggtacagtgagtgaagaagcaattcaaactgcaattcgtgagaactttgacttacgacctgctgggattattaaaatgctagatttacaaagacctatttatgagcagacagctgcttatgggcactttgggcgtacagatgttgacctttcttgggaacgattagataaagttgatgctttaaaagcaagtatcgcaaagctaaatcactaaatggagaagagaaagacaaatgtattattagtaacgatcgcgttgtttgtcgcgacgtttatgactgcaattgaagggacaatcgtttcaacggcgatgccaacaatcattagcaacttacacggtatgcgcttgatgaattgggtgttctcaatttatttattaacaaacgcgatgatgacgcccatctatgggaagatggccgatcggattggccggaaaccaatttttatttttgggttagtgttattcgtgattggctcatccttatgtgggttatcaaatcatatggaaacattaatcatttcccgggcaatacaaggcttaggggctggtgcaattatgccagtatctttcaccatcattgctgatatctatccgattgaaaaacgggcaaaagtccttggttttaacggttctgcatgggggattgcctcaattattgcgccacttttaggtggctttatcgttgataagttaacgtggcattggattttcttcatcaatgtcccaatcgggttaattaccattggcttaatttggtatttcctacaagaagaaaaacgaacgagcgatcaaccaatcgactactggggtagcttctggctgatgatggcacttttaggcctcttatacggcttccaattaatgggtgaaacacacttgtcatggggcttattagtaccagcactcgtgattgccgtcgttgctttcatcttattcgtacgcgttgaaaagaaagcacaagaccctattatctcattatcattatttaaaaaccggaccttcgtggttcaaaatgcggtcgccgctttagtcagtggtttcttgattggctttgaagtttacatgccaatgtggatgcaaggtattctgggcttgaaagcttcaatggggggcttcgtggtgacacctagttcaatcatgtggatcttcgcttcattgtgggcaggccagttattagtgaaacatgcaccacaacggattttaatgggaagtttggcaattctacttggtggcagtattgtcttagcactcgtgccacaaacaacgccattttggttcttcttaatggtcgccgcttgtttagggattggctttggaatgatcattacaacgaccaccgttacgtcacagagtgttgcgggttcggataaagtgggggtcgcaacttcatttaatacgctgagccgaacattggggcaaacattgatggtgtcagtttacgggattattttaaaccgtcaattggccaaagggattagtggtgattcacgcttgaatcaaaatatgcttaatgaattaattaatccggaaacggctgctaaattaccacaaaacttattaccagatttacggcatattctatataatggtttgcattatatctactttgcttcaatcgtcttaattttagtcgcaatgtggattaatttatcagatcgtcgtcagaaacaataattatctgaatagcacacaaacgccttctggggtctctaatcctttttgacaaggggttaataaaccagtttgagcgtctcggtgatagagcgtaccattatcgctattttgattaacggcaaagagaaattgatcgttagcggagaggttgaagtcacgagggaattcaccatccgttgacatttgttgaatcgttgtgagttgttgaccatctgcgctaatacggtagaccacgatagaattatagccgcgatttgaggcgtataggaattggccgtcttgtgaaatacggattgccgcaccaccattagcttcgtgccaatcatctggcaacattgaataagtttcaacggctgtaaattcaccagtattggcatcatagttgagaacagtgacttcacttgaaagttcgcctaaaagataagcgacttggtgattaggatgaaaaacgaggtgtcgagttccaaaaccaggttcactatggtaagttgctgttttagttaagtcgccattgtcagcaattgtataagttgttagttcatcggtgcccaaatcacagacagctaaccgattatctggtgtgaggtcggtataatgaacgtgggcgcttgcttgttctggacgaggaccatgaccagtgtgttggaccgtgttggctaatacgaggtggccatcattttgaatggcataaaccagaatttcgcctttatggtaattagcagcgtagaccaattgacgtgtctcatcaacagccacgtatgctggtggtgcaccagcagctaagacggcgtttaaataaaccggtgttgtgccagaaatatcataagcagcaatgccaccttgctcgccttctttaaccacggtatataaaatttgttgtttggaaatagccaaatatgaggcgttatctaaagtgatataaggtttaatatcagtgattgttgcggtttcaggtgagagcgtaccacgataaatgcccttaccaattcgacgggtataacccccaattaaaacttcttcagtcatatgataatgcaagcagagatcgtggcaatcggggcccaagcaattgatgccgccgaaccactggttattttatttaacgaacaagcaacaccagcgattaaggcagtcgccctcattcaacgttttacgacggctaatcaatctgaacgacttacgatgacaacccagtcaatcgttgtgattgatggacaacactatcaagtcacttatgttggggcacttgttaatgaaaatctcaataatattgggcatgttgcgttgatctttgattcagcaccagaagaagatcaacttcaaagtggcctttacttaacacctaaagatgctagtttacaaggcaaacccgattttaaagtggggacgctaatccagtatcaagaaactatgtaggtggctgatcgtaaacaaacgaaggaacaatcttggttttttaagtggtttttaaataagaaattaccagtaattttgttaaatgtttttctagttttgctgattattttattggcaactaaattagcgtggttattggagccgattcagcaattgatgttgattgttggcttaccgattattatcgcggcggttctttattatctgattaatccgctaattgattggttagagcatcgttggcatcttaaccgagtactatcaattaccttaatttttattgtgattgtggcgttattggcctggggtgtcgcaacgattatccccattatccaatcgcaaacaacgagtttaattaaacaatggccatcgtattgggcgaatattcaaaagcagacgatgagttggtttaatgatcccagttttaagtcgttgcaaaagcaattggacgatattaataccgatatgttaagcaacttatcagggaaagtgaataagatgttaacatcgactgtgactcatatcgggacagccgtcggggttgtgacaaatattgtaatcgcaattgtgacgatgccatttattctctttttcatgttaaaagacggtcatcgtttaaaaggctaccttgttaaattcttccccgttagaattcgggaaaccaccagtcaggtcttggaagaaattaatggtcaagtcagtcaatatattcggggccagttaacggttgccttttgggtagcagtgatgtttacgattggttattggattgttgggatgaaatatggattgacgttagggattttagcagggctgttaaacttgattccatacttggggtcattcctagcgttggtgccatcggtcgttattgcggcttttatctcaccaattctgctaatcaaagtcttgttggtttttgccgttgagcaaaccttagaagggcgggtagtctcgccgttagtccttggcagcaagatgtcgatgtatccagtcacgacgattatcgtcttattggcctccggtaagctattcggattagttggcgtcattgtcggtattccggtttatgcgattattaaaatcctggtgacacacttatttgaatggtttaaaaaggtatcaggcttatacgaataattaatgattgattgttagtttcatatagtgatgcgggatgttagcttccatttcaccttcactaatcacttcaaagcctagtttttcatagaaaccaatggcatgatcttgtgcaaataagatgatgtagggcgtttttgtgcgcttggcatcttcgataattgcctcaattaatttaaaaccaaggccctgacctctaaatgacttaattgtggcgacgcgttgaattctaaaaccgccatcttttagtacatggacacgtgcggttacggctgggtcttgctcaatgtaaccgacgtagtgaatagtatgatcttcatgtgcatctatttcttgtgtttccggcatattttgttctcgaacaaacaccgttcttctaatgtaagttgcatcacgaaagataacactgttatcaccaagtgtatgtttaatatccatctacaacatatcgccattaaaaatagaatgacggacaagaacgtaatccacttttcgtagtgctgataagcgcttgccaccagcataagaaattgaagattgtagatcctgacgcatttcggtaagggtgtcactaattgaccccttgtaaggcactaaaattcgtttgccctcaacattttggtgggtacctttttggaattcagaagctgaaccaaaatattccttaaattgttggccatcttcttcgactagttcgccaggagattcagtatgaccggcaaaaagggaaccaatcatgaccatgttggccccaaaccgaattgatttagcgatatcaccgttagtacggataccaccatcagcaatgatcggtttggttgctgccttggcgcaccagcgaagggcaccaagttgccaaccaccagtcccaaaaccagttttgattttagtgatgcagactttaccagggccaataccgactttagttgcatcagcaccggcgcgttctaagtcccgaaccgcttccggtgtgccgacgttgccggcgattacgaaacttttaggtaaaacttttttgatatgttgaatcatatcaatcacgacttgtgagtgaccgtgagcgatatcgattgtaatgtattctgggatgaggttatcttgtgcgagttgattgatgaagtcaaattcatcgtccttaacgccaacactaattgaagcgaataggttgcgttcgtgcatcatcttgatgaatgccgggcgtttttcaggttggaaacgatgcatgacataaaagtagtgattttcggcaagccaaatggccagcggttcatcaataatggtttgcatattagcagggaccacgggaattttaaaagtctctgaaccaaagcgaacagtggtatcaatttcacttcgacttttgacgatacatttattgggaataagttgaacatcttcgtaatcaaatacgtccatttagaaataacgtttccgccagaagcgaaaccctaggagccccgcaatggttaaggaaatcgcaatggtgacaatccaactaattttaaaattggctaaaggtaaggcaacgttcatcccgtagaaactaaagactaagccggggatggttagcatgatcgaataagatgctagaaacttcatgacgttattcatgttattattaataattgatgaatacgtatcagctgtttcattgataattgaattggaaatctcggccatttcgatcgcttgttgattttcaatttgaatatcgtctaagaggtcaatctcagattcgttgagcattaacatgttagagcgcatcaaactcgctagtaccatcttatcggtttttaacgacatcatgaaataaactaacccgcgttgaatccccattaaatcgtaaagctcttcattacgtagcgacttttgcaaacggttttcaatacgttcacgggaacggttgatatctcgcagatattgcagataaatggtcgaaatgcgatagagaatttggaggacgctgcgccgttgttcctgtggattaaagtttttgatttgattatcaataaagctctgtaagaaatcaactggcgttttattgatggttaagatgacagaatctgttacaataatccctagaggactcgttttgtagcggaatttatcagcttgctgatcatctttttcaagaatcggcatgttaaaaatgattaatgtcgcgttataatctggatcgtgttcggcacgcgcactttcgtcggcatctaaactataatagatgaaatcggaagggacgtgcagttttttagtcagtaaatcaatttcttcttgcgtgggatcggtaatgttaatccaactattgggttggattttagcatgcttggttaacttctttttagcttcatcgaagcgataagtatctagcatttgaaaaaaattgatttagcgcaacaattcctacaagccaatttaagcgccttgcaatgtccaatttgccaaggggcgtttgccactattagtgatcaccaattggtttgtgaagcgggccatagttttgacttggctaaaaatgggacattgtacttcttacccaaacaaatgaagtctgaatatacaaaagaaatgttaagccatcgccgggcattcttacaggccggcttctttaaaccgttcttagatgaaattgctaagcaacttacggccaatagtcggattcttgatgttggttgtggcgaaggaacgccggtttaccaacttgcccaacaggtaccagcccaatatatcggctttgatatttctaaaccggcaattcaactggccagtgattacaatcaagaaggttggttttgtgtcgctgatttagcgcggatgccgtttgctgatcagagtttggacacagtcttgaacatcttttcgccatcgcaataccaagaatttaaacgggtgctcaaaccggacggtcaactcattaaagtcattcctaatgccggttatttgcacgagctacgagaattattatatcagggtcaggaaaaggaaagctacgatcatggtccagtattggacttattcgaacaacattttcccggctaccaagaaattcaggttcaacaaaagatgaccttaacacccgaaacactagcggatttagtcgagatgacacctttaacttggacagcaacagaggcgcaattacaagcgattacgttggcggcattaccagagatatcattggatgtcacggttttagtgggaaaacaatgagtgactaatcatattgttttatacgaaccacttattccagctaatactggcaacatcgcccggacatgtgccgggacggatactgttttagatttaatcgaaccattaggctttgaaactgacgacaaacatttaaaacgggctggtctagattattgggaccaagtgaagattaattaccacaagaacttggatgcctttttagaaacggttccggatcgtaaacacctctatttgatcacgaagtttgccaagcaagcttattctgatcaggatgtgacggatacaagtgttgatcattactttatgtttggtaaggaaacaactggcctcccagaaacgtttatgcgtgaaaatgaagatcagtgtctccgcattccaatgtcagatcacattcgggctttgaatttatccaactgtgcagcattggtcatttttgaagcattacggcaacaagattttccagggttagaaaagagtcatctgtacgatcacgataaattaaaatagatgcaaactaaaaaagatcccattagcgttgatgcttttcattttgaccgtgtgtcaccggacgccgaaccacaacaaaatatccaagtgagcttagtgaaaattgatgctgacgacgaatatttacaagaagctgatttaaaagccggtaacatctatcaaatcgttacaccattccaagtgatgccacaaggaagcggctttgccgtatctggtcaaatttcacgggttgttcaattgttagatttctttggcacaccagatgaaatcggacaaaaggaaatgatgaaattatcacgaccattaatcgaatacattgaaaccttgacgtatcaagtaacagcggttgctttgaacgaagggattcaacttcaatttacagcgcatgaaacaccagaagaagcataaatggcaactcaaacgaaaaagcgtaagaaaaaaacgacgactaagaagaaaaaaatgcaacagcctgattacacgattaattttgtcggctttttgtttattttaattagtcttttctccgggctgaaattaggatttatcggcacactatttgcgaatgttttccgcttattcgttggtgacacattcgtcctgggcgcaattctatttgcaatgctcggtatttacctcttaatttatggcaaacaaccaccattgtggcaacaaaaaacggtgggttttagtttagcctacattggtattttaatttggctatcagctttcatcttgcaccaacaagcgattaataaccattttgtcgcagctacttggcgcttattgtttgaagatttccaaaaaatggcagttacgacggaggtcggcggtggcctagttggtgccgtgatttatagcggttcgcattttttgtttgcacagatggggacctatatcattgccgtgttagtgacagtcatggggctgtttatttttatggatattcccttcagcgtggttgttaaaagcagtcagcgctttgtccacggcttatttcaagtcggacgctatactaaatcaggcttggtgaaggccactgaaaagggccgcgatcaagtcagcgcgctcaaagaacaaacgcaaaatgcgttgtctgcggttgacgaaaaaacgacgccaaccaagacggttaaaaagcctacctcagaaccgaccggcgagcctgagaaaacgggggttgtggtgaatgaaccagccacctttaagattaatggaccgaaggatttaccaaaaccaattgcaacgcaccaagcaactaacgaggcagaagcaactgcggaaacaccgacagaacaagtgccggatgttgccgaattaacgcatgctgtagaaattgatgcggattatgaaatgccaacgcctgaattgttgacgcagattccaccatcagatcagagtgcggaatacgaagcgattgaaaaaaatcaacaggtcttgaaacaaacctttgattcgtttggcgtggatgtcacggttaagagtgcaagtttaggaccagccgttacgaagtatgaaatccaaccggctgttggtgttaaggtgtcgaagattgttaatttggccgatgatttagcgttagcactggccgccaaagacattcggattgaagcaccgattccaggcaaaccatacgtcgggattgaagtccctaatacaactgtctcaacagtttccttcagagagatgatcgaacaagagccaccacatccaggcaaaccgttggcagtgccattagggaaagatatttccggtaaagtgattatgtcggatttagcgaagatgccgcatcttttgattgccggttcaacgggtagtgggaagtcagtagcgattaacgggatcatcaccagtattttgatgagcgcgcaaccccatgaagttaagttgatgttgattgatccgaaaatggttgaattaaatgtctataacggaattccgcatctcttgattccggtggtgaccaacgctaagaaagcggccaacgcgttgaataaagtcgttaaagaaatggaacgacgctatcaactttttgcggatactggtcagcggaatatgaccgaatataaccagtatattcaaggccataatgaagatggcgaaatcaagggcgcggcgttaccatacattgtcgtgatcgttgatgaattatctgatttgatgatggttgctagtaacgaagttgaaagtgccattatccggttagcacaaatggcccgggcagccgggattcacatgattgttgccacacaacggccatctgtcgatgttattactggtttaatcaaggccaatattccatcacggatcgcgtttgcggtttctagtgggattgactcacggaccatcttagatggtagtggggctgaaaagctcctgggtcgtggggacatgttgtacctaccaatcgggatgagtaaaccactccgagttcaaggcgcctttatctccagtcaagatgttgaaagcatcgtttcctttatcaaagctcaaaagacggctgaatatgatgaagagatgattccaacggcggctgatgaacaccaagaaacggcagatccagaagatgaatattatcaagaagcggttgaattagtggttaagcaacaaaccgcgagtgtttcgatggttcaacgtcgttttagagtcggttataatcgggcagcccggctgatcgatgaaatggaaagtcgcgggattatcgggccttctgaaggtagtaaaccccgcaaggtccttttgcaagaggttccaagcgaacaaccaccaactgaataaatgaatcaaaaagtaatggatggcgtttatttaaatatcttacaaacacaacaattcaaaacaattcgcttttctgtgcaattagtggcaccagcgactaaagaaaccctgacaaaacggtcattactagccagtgtcttatctgctagtagtcaagcttatcgtgatcaggttgcaattgccaatcaactccaagcaatgtatggggctggcttcaatatgaatgcatatcggcaaggacaattagcgatttttagtatttcaatgcggattgtcagccctcaatatttacgcgatacaatcgacttacaacaacaagcaattgcctttattggcgaactacttttaaaaccagatgtcattgatcaagcctttaacgcggttacttttgatcgggaaaaagaaaacttgcaacgctatatcgatagcgttgccgatgacaaacaaacttatgctgcactcaaactacgtgaactctactttacagatcaaacgcaacaaacgcctaattatggggatgctgacgttttaaagacgattacagccactgatttatacacttattatcaacagatgattgcaaatgaccgaattcaaatgacggttgtggggaatgtggatgaagaaaaattggcgcttgatttggcgcaattatcactagcaccacggggcgaaatgctacctgggattttttatcaacaagctgctagcaatgcggtccgtgaattgacggaagaacaagcggttcaacaaggtaagttaaacatggcttatcaattgccagcttacttctatcaaaaggattattacgcggccttagtgatgaacgcgttatttggtgggacaccactatcgttactcttcacgaatgtccgtgaaaaggcgagtttggcctattacgcttctagcaatatcgatgctttccggggggctgtcatggttcaaaccggaattgaaagccatcaaaaagaacgcgtactagccattattgaagcgcaacgccaaagtattatcgctggtgattttacacaagcgatgtttgaacaaaccaaattagccttaattaatcaatttaaatcaagtcttgatagcccaggttatttgggccaacaacagttcaatcaaatttttgtccccgaaacggaactagacgcgggtcgattcacgaccgctattttggccgtttctaaacaagcggttcaagaacaagccgctaagatgcaactgcaagcaatctacttcttgaaaggggtcgacacaaatgaagcttagatgaagcttagacaaaatccccgcttaggtgaaaccctctatgaagaaactctggaaaatgggttaacggtcaaactctatcctaagagtggttatcacaagacctatgccattttaacgacagactatggtgcaattgatacgacttttgtgccagcaggtcaaactgactatgtgacggttcctgacgggattgcacatttcttagaacataagttatttgaaaaggcggattatgatgcctttgaaaaatttgggcaatttggggctagttcaaatgctttcacgagcttcacgcgaacaagctacctcttttcaacaaccagtcatttgaaggaaaacttggatatcttgcttgattttgtgcaagaaccctattttacaactgcaacggttgataaggaaaaaggcatcatcggtcaagagattcagatgtacaatgatgaaccagattggcgcttattttatacggtaattggcaacctttatccacaacacccagtgcgaacggatattgctggcaccatcgaaagtattgcgcaaattacgcctgaagaattgtaccaagcgcaccaaacgttctaccaaccaagtaatatgaatttattcattgttggtcagatcgatgaccctgaagaagtattgtcgtgggtcagcgctaatcaagacgctaaagattttgtagcaccaagcgacattaaccgctcattaccagaagaagaagctgacggcagtgacattattccgtaccgctcattagaaatgccggtgacacgcagtaagagcatggtcggtattaaagggttaaccgattttggaactggtcaagaagcactagaaatgaaaattaagatgaacctgttattagaattactctttggggattcatcaacacaagttcaaaaattatatgaacaagggattttggatgacagctttggctatgaatatgccattcaacgctcatttaacttcatcacgcttggtggcgatacagatgatgcacaaggcttatcagatgcgttgatcaatattttggaacattatcaggaaagtcctgatttttcagaagccaatttagcgttggttaaaagagccgcaatcggcgaatatctacaggcctttaattcattagaagcaatcgccaatcaatatagcgacgcctttttcgatgaagtaagtccgtttgatgtgttaggtttaattgaacaagtgacattagcggatttggcacaagttgctgccgaattcttcaaaattgaaattatgacggtttgccatatcttaccagaggtggcgcaataaatgagttgctcagctttaattattggcgcctccggtgatattggcgccaccattgccgaacgcttagcagcggacggctggtcgctttatttgcactacaaccaaaatcaagaacgtatttgcaaactacaacagcaacttagtcaacagtatgcgcgccaagacttttttgcacttcagttggatttaacgatgggcactggtgcggttgaccagttgaaaagtcagctgtttcaagtggatgcggttatttttgccgctgggatgacgacttacggcttattgccagaggtctctgcagagcaaattgatgcgttgtggcaagtgcacgtgaagacaccgatgttgattttacaggctttgcagtcgaaattagcacagagtgatttgggccggattgtttttattggctccatttatggcggtcgtggtagtgcgatggaagtaccgtacagcacggtcaaaggcgcgcaatcggcgtttgccaatgcttacgcacaagaggtcggctcgctaggcattacggttaacgtgattgcccctggcgcagtagccacgaaaatgaatcaacagtttacagcagatgaacaagcggcgattgccgctgagattccaactgggcgttttgcgacgccaacacagattgcttattgggtccagactttgttagcaccagaagccaattatttaacaggacagacaatttatgttgacggtggttggctaaaataaatgaacgaaattggtcaaaaattacgtgaagcacgtattgaaaaaggttatacattagatgatttacaacaaattacgaaaattcaaaaacgctatttaagttcaatcgaagagggcgatttcgatgcgctccctggtactttttatgtgcgtgcgtttattaagcaatacgcacaaacggtgggtgttgatagtgaagccttattagctgaatatcaagataagttgcctaacgcaaaaccagaagaatacgttgaaaaatcagttgaaaatcaaacgcgattaacacgcgaaacaaccgactctaaatggtcaaaatggcggggattagcaccacaaatcgccgttgttgctgtcgtgattgtgattgttgggattgtctatggtattacgttaagtaatcgtggcaagaatcgggaaacattaactgaaaccagttcatcagtgacggtttcaggtgaccaatcaacaactaaaaaagcaagctcagacgataatcaacaaaaagcacaagaaagcaaggccaaagaagcttctaaagcaagcgaacaatctaaaaaagaagctgacaaaaaagcaaaagaaactaagttatcagcttcaatgacaagtatgagtggttcacaacaagcctttacaattaaaaacttacctaacaaagccaatacattgacgttctcagctgaaaacacaacagcttgggtgggcttaattgtcaatgggtcaacaatctggcagggttctgttacaccaggaactgatcaaacaacgcaattaccagctggggtaacacaattctcagttaaaactgggaacgggcctgcaacgaagatgaagattaacgacacagctgttaatttaaatcctaataatgaaacagttcaggttcgaacagtgaactttacagcaacacttgcaaaataaatgaatttaccaaataaattgacgatgtttagaattattttaattcctatttttacaatcctattagcgtttaacgtaccggcaggtgaagtactcgttgctggaacggctattccagtcagtgaattgattgcaacggtgatctttattgtcgcatcattgacggatttgttagatggaaaaattgcacgttcacaacatttggtgactaactttggcaaattcgctgatccactagcggataagttattggtaatgacagccttcatcttccttgttgaactcggtgcagcacctgcttgggtggttgcgattattatttggcgtgaattagcagtgactggcctcagattacttttgagccaaggtggggaagtcatggctgctgccatgcctggtaagattaagacgacaactcaaatgttggcgattattttattattcttgcataacgtgttctttgcaaatatcggcttaccaatggctgatatcatgttatacgtctgcctattcttcacgatttattcaggcacagaatacttcatcaaaaatcgtggtatcttcaaggattcattttctaaataattggctaaagatgaaagacaagcagcacttgatgctgccctaaagaagattgaaaagaattttggtaaaggttcaattatgcgaatgggtgaaaaggttgatacacaagtctcaacagtttcatctggttcattggcattggacgaagcgctcggagtaggtggttatcctcgcggccggatcgttgaaatttacggtcctgaaagttcaggtaaaacaaccgttgcgttacatgctgttgcagaagtgcaaaagcaaggtggaacggctgcttatatcgatgctgaaaatgcgatggatcctaagtatgcaacagcacttggcgttaatattgatgacttactcttgtcacaacctgatactggtgaacaaggcttagaaattgctgatgccttggtatcaagtggggccgttgatattttagttgtcgattcagttgccgctttggtaccacgtgctgaaatcgaaggtgaaatgggtgacgcccacgttggcttacaagcgcgtttgatgtcacaagccttacgtaaattatcagggacgattaataagacgaagacgattgcgttattcattaaccaaattcgtgaaaaagtcggcgtgatgtttggtaaccccgaagtcacaccaggtggtcgtgctttgaagttctactcaactgttcggcttgaagtgcgtcgtgctgaaaccatcaaaaatgggacagatatgattgggaaccgggcccgaatcaaagtcgttaagaataaggttgcgccaccatttaaggtcgctgaagttgatatcatgtacggtcaagggatttccagaaccggtgaattggttgatatggcggtcgaaaaagacattatcaataagagtggttcttggtactcttatggctcagaacgaattggccaagggcgagaaaatgctaagaactatttggctgatcacgaagatgtcgaagatgaagttcgtttgaaggtcagagcagcttatggtatttcagatgtacctgaagaagatctcccaacaactgaagatgaacaaataaatattttaccagatgattcaacagaagaataaatgaacttagatttgctattaatccttaccgcagtcatcatgttaatcgtcggttttgccgttggtgcaattttgcaaaagaaggcccacgaacgtgaaattgatggtgcaaataagactgctaagggaataatcgaattagctgaaaaagaagcggcaacgcgtaaaaaagaaattcttttggaagcaaaggatgaaaatcatcaatatcgctctgaaattgaaaatgaattgaaggatcgacgtggtgaagttcaaaaacaagagaatcgcttaatacagcgtgaagaaacgatggatcggaaagatgcgacgctcgataaaaaagaacggacactggaagaacacgaaagtcgtttggctgagcaagcgcaacaattaaaggaaaagcaagcagaagtcgaaacgttagttgaacaacaacggacgaagttacaagagattgctgaactttctcatgatgatgcgcaaaagatcattttggacgaaacaaaacggaacttggatcacgaacgtgctgttttaattaaggaaagcgaagaatctgctaaggaacatgctgatcggacagctaaaacattagttgctgaagcaattcaacgtagtgcagcagatatggttgccgaaacaacagtgactgttgtgacgcttcctaatgacgatatgaagggccgaattatcggtcgcgaaggtcggaatattcgaacacttgaaacgttaactgggatcgacttaatcatcgatgatacaccagaagcagttgttctaagtggtttcgatccaattagacgtgaaatcgcacggatgaccttagagaagttaattcaagatggtcggattcatccggctcgcattgaagaaatggtcgataaatcacgtaaggaaatggatgaacaaattcgccaaatcggtgaacaagccatttttgatgtcgggattcataccatgcatccagacctcattaagattctaggtcgtttacacttcagaacaagttatggtcaaaacgtcttgaatcactcaattgaggttgctaaattaacggggattttagctgctgaattaggcgaagatgtcacactcgccaaacgtgctggcttattacatgatatcggtaaagcactggatcatgaagttgatggctcacacgttgaaattggtgttgaacttgcaacgcgttataaggaaccggcaacggtcattaacgcaattggctcacatcatggcgatattgaagcaacatcaatcatttcagtcttagtagctgcatctgatgcaatttcagctgctcgtccaggggcgcgttctgaatcacttgaaaactatattcatcgtcttgagaaacttgaaagtattacgaatagtttcaaaggtgttgatcatagttttgcaatccaagccggccgagaagtccgcgtgattgttaaaccagaacaagtcacagatgatcaagcaactgtcttagcacgtgatgttaaaaaccagattgaagatcaactcgaatatcctgggcacattaaggtcacagttatccgagaaacaagaacagttgaatatgctaagtaaatgatgcccatgtttagaatcatcgttgggttgtttgcgaccatgctcgtttcggccgcaattacaccgctcgttagacgcttagcttttgtcttaggcgcggttgataaacccaatgctcgccgagtgaataagaaagcaatgccctcaatgggtggtttggcgatttttattgcctttaatgtaggcacttttattctattgcgcggacagtttccgacgcacgaactatttagcatctttttagcagaatgtattatcatcatcaccgggatgattgatgatatcaaagaattaagccctaaagaaaaaatgttagggattttaatcgctgccttagtgatttacttcttagcgggtgtgcggatgaatatcctaacaattccgcttgttgggactttcaaattaggatggttaagttttccaattacaattttttggatcttagcgattaccaatgcggtgaacttaattgatggcttagacggtttagcgaccggggtctcaatcatcgcgctattcacgatgggtgtaattgcctatttcttcctatcgattaccaatgtgagtgtttcaattatgattttctgcttaggggctgcgttaatcggcttcttgccgcataatttccatcccgccaagattttcttaggggatacgggggccttgtttataggtttcatgattgcggtcctatccttgaaggggttgaaaaacgtaaccttcattacattattgattccagttattattttaggggtcccaattacggatacggtttacgcaatgttacggcggatcttaaaccgcaaaccaatttcacaagcggataaacatcatttacatcaccgcttgatgcaattaggattatcacaccggcaaacggtattggttatttacggtttagcgttggttttctcactcatttcgttactatacccattatcaacattgtgggggagcttagccttaacaatcgcggtcttgattggcctagaattgtttgttgaatcaattgggttagttggcgagaatcgccaaccactattacacttactaaaacgattattaaaacctaaagacgaagaaaaggattagttatttttgataacgcaagtcgtgaatcgcttgcgcgctgatggggacttcgttaaattgttgttgtccaagccctaaggtgagctgaccattgagcaattccgtcatttgggcctcaaaggcagggacttcttcggtggggagccagaccgttagttggatattggttgtgtattgaatatcctgagcaatcaaatccagttgtgctaagcgattttgaagggagtcaaactgtgcataatcaatggttaaatgacaggcagtttgttcgattccttgaacgataccgagatgctcgagagcagcggaagtcgcgtggctataagcacgaattaaaccgccagtgcctagcttagttccaccaaaataccgagtaacgacaacacagaggtttgtaagttgcatttgacgcaagacttcaagaattggcacacctgcagtgccgctaggttcaccatcatcgctttgcttttgaatattagcaggttgtcccagttgataggcgaaacaattatgattagctttcgtatgtgttttacgaacttggtcgatgaagtcttgggcagcggcttcatcgctaacccgagcgatttgacaaataaaacgggactttttaatttcaagttcaaactgcccgtctgcttgaacggttaaataactttccatatgggacaacaagtaattgcctgtggtcgccagtttacggcggcccagttagccgatacgcaaaataataactatagtttaccacagattaagcggcgacctgcgtttttacgggtcaagcatcgcctagtctgccaacgttgtcagcaagtggtgccgccgcaaacctgcttaccagatgggcgccattattgcgcgcaatgtttgttatttggtcgtttggtagagggcgattggttatacacggtaccggagtgtcatttattcgaaaataacataccaaagttgacgtgggaggggcaattaacaccgcatcaggaacaagctgcccaagcggtggttgaggtggttcaaacacaaaaacggcacgtattaacggccgtgaccggcgcagggaagaccgagatgctttttcaaggaattttagttgcgcttcaaaagggtcagcgggtatgtctggcagcgcctagagtcgccgtttgcttggaactttatccgcgcctgcaagctgcctttgcaacggctagtatcatgttgatgcacggtgagcaaactgagccctatcgctatacgcagttagtgatttgcacgacgcatcagttgctgaagttttatcacgcctttgacactgtgattgtcgatgaagtcgatgcttttccttttgttgataatcccgttttagtcacggcagttgaacaagcctgcaagccccaatgtgctttattatatttaacggcgactccgacccccgctattaaacgggcaattgctgctaaacaaatgacggttagcgaattaccgctccgctttcatggtcatctattaccagaaccacataggcacgtcgcttttaattggcgggcccaattaaaaaaaggtcggttacctaaacgacttgagcgggattgccagacttgtttaaaaacacaacagattttgttattcgtgccgcaagtgcggttattgcaaccagttgccaatcggttatcaaccttattgccggcggtcaggattgaaacattgcatgctaacgatccggatcagattaaaaagattacggcgtttagaacacaacaaattcagctaatggtgacgaccaccattttagaacggggcgttacgtttaaaaacgttgcagttttggtcttaggcgcggaacacatggtgtttaacgaagccgttttggtccagattgccgggcgagcgggacggcataaagattatgcccaaaatccggttcatttttattatcaagactatacgcgggcgatcaaaggcgcttgtcggcaaattaaggcccaaaatcagaggggacggcgattacaatcaactgtttaaatgtgccacaatttaattatcgaaaagccaagtatcaagcaacttttgcaattaaaaccactacttaatccgcatatctgccaagtctgtttacagcggtttgaacgcattagtggtcatcggtgttcggactgtagtcgaccgctgctaacgggtattttgtgccctgattgtcagcagtggcgacaacgttatcctcagcagcatcttaaaactcaggtactgtttacttataaccgagcgatgcagttatattttcaacgttataagggccaaggagactatcaattacggctattattcgaacgcgacattcgaactcggtttccagtaaaatccaatgtaacttacgtgcctattccatctgatgagcaacatcaacaagaacggggctttaatccagtccaaggcttattcgaaacttgttttccgttaacatcgctattgaaaaagcggccaacagagaagggccaagcacaaaaaaatcgtgcagaacgtcttgcaagttcacaattttttgaattaataccgcaagaattaccgcataagccacaatcgataataatcttggatgatatttatacgacgggccgaacggtgtggcatgcacaacaatgtctgcgtgctcggtatccacaaattgcaattaatgcgattactttagccagatagatgctaagttttaatgtccgtggagaaaatattgaagtcacagaagcaattcggagttatgttgagaagaaaatcagcaaactcgaaaaatattttgatgaatcagctacagcaactgcacacgttaacttgaaagtctatcctgataaaacagcgaaggtcgaagtgactattccgctcccttacttggttcttagagccgaagaaacatcaccagacatgtacggtagtgttgatctggtaactgataaactagaacgtcaaattcgtaaatataaaacaaaaattaatcgtaaatcacgtgaacgtggtatcaagggtgttgaattagtggtttcttctgaagaaactttaccagaagaaccaatgcaagttgttagaactaaacgtgtttcattaaaaccaatggatagcgaagaagctatcttacaaatgaacatgttaggtcatgaattctttatctttgaagattcagaaacaaatggcacaagcattgtttacaaacgccaagatggtcgttatggtttgatcgaaacagatgaataaatggcaaattttctaaaatcatgggtagaaagcgataaacgtgaagttggacgaatgggcaaaattgccgataaagtacaatcttatgaagatgaatacagtaatttatctgacgaagcgttacaagctaagacacctgaatttaaaacaagattagcaaatggcgaaacattagacgatattttacctgaagcattcgcggtcgctcgagaaggcgctaaacgcgtgcttggtttattcccattccgggttcaaattattggtgggattacattacacgaaggtaatatcgctgaaatgaaaactggtgaaggtaaaacgttaaccgccacaatgcccgtttatttgaacgcgcttgcgggtcaaggggttcatgttgttaccgtcaatgaatacctttcaagtcgtgatgcgactgaaatgggtgaattgtataactggttagggctttcagttggtttgaacttaaatgcgaagacccctgaagaaaaacgcgatgcttacaactctgatattacgtattcaactaatagtgaacttggctttgattacttacgtgataacatggttgtttacaaagaagaaatggtacaacgcccattgaactttgcgattgtcgatgaagtggattcaatcttaattgatgaagctcggacaccattgattatttctggacaagcagaaaaatcaacggcactttatattcgtgcagatcgttttgtgaagacgttaaaagaagatgcagattataaaatcgattggcctacaaaaacaattagtttaacagaagccggtatcggcaaagctgaagctaattttggtcttgataacttatatgacattgaaaatacagctttgacgcatcatttggatgaatcattgcgtgctaatttcatcatgttgaaggatatcgattatgtggttcaagatggtgaagtcttgatcgttgatcaattcactggacgtgtgatggatggtcgtcgttattcagatggcttacatcaagcgattgaagccaaagaaggcgttgaaatccaagatgaaaccaaaacaatggccaacattacgtatcaaaattatttcagaatgtataacaaactttcagggatgactgggacggctaaaaccgaagaagaagaattccgtgaaatttacaatatggaagttatctcaattccaactaaccgcccaatcgcacgtaacgataaatcagatgtgttatacccaacgcttgaaagtaaattccacgccgttgtgaaagacatcaaatcacgttacgaaaaaggccaaccaacattagttgggacggttgcggttgaatcatcagaattactatcacgtttattagacgaaaataatgtgccgcatgctgtcttgaatgcgaaaaaccatttcaaagaagctgaaatcatcatgaatgctggccaacggggcgctgttacaatcgctactaatatggctggtcgtgggactgatattaaattaggacctggtgtcacagatttaggcggtttagccgttatcggtactgaacgtcatgaatcacgacggattgataaccaacttcgaggccgtgctggtcgtcaaggtgatcctggtgaaacacaattctatatgtcattggaagacgacttgatgaaacgttttggttcagaacgaatcaaagcattcctagatcggatgaagatttcagacgacgatgctgtcatccaaagtaagatgattacgcgccaagttgaagccgcacaaaaacgggttgaagggaataactatgatacacgtaaacaaacccttcaatacgatgatgtcatgcgtgaacaacgtgaagtcatttataaacaacggatgcaagtcattatggcagaagacaacttaaaagaagtgattatgccaatgatttcaagaacggttaaacgaatcgttcaattgcacacacaaggtgatacagcagattggaaccttgaagcaattcatgattttgcaacgacttcaatggttagtgaagaacaattaacacttgagaagttacaaggcaagtcagctgaagaaatcgaagcattattgatgacttttgcagaaaagaattacgcgacaaaacaaaaacaattatctgatgaaaatcaaatgcttgaatttgaaaaagttgttattctccgtgttgttgatgaacgttggacagaccacatcgacgcaatggatcaacttagaaattcaatcggattacggggctacggtcaaatgaatccattggttgaatatcaagaagaaggctacagaatgtttgaagaaatgattagtgatatcgattacgatacaactcgactcttcatgaaggcggaaattcgtcaaaatattcgacgctaaatgggcgatcctgatttttggaatgaccaacaatcagcgcaacaattaattgatcaaaataatgtgttaaaagaaaaatatgattcttttaaccaattacaggcgcagtttgaagaattgagtgtcactttagagttattacaagaagaacctgatgatgagctacaggcgagctttgaagccgacttagagcagattcaaagtcagatgcgccaatatgaattggggcaattattatcaggtgaatacgacagcaataacgcaattgttgaattacatcctggtgctggcggaacagaatcccaagactggggtgccatgttattacggatgtatctccgttgggcagatgcgcacggttttaccgtagaaacagaggactatcaagcaggtgaagaagccggcattaagagtgtcactttgatgatcaagggccataatgcctacggattattgcgctctgaaaaaggggtccatcgcttagttcgtatttcaccatttgattcagccggtcggcgtcatacatcattttgttcggtcgatgtgatgcctgaattagacggttcgattgatatcgaagtgcgcacagaagacttgcgggttgacgttttccgttcaagtggggctggtgggcaacatatcaataaaacctcttcagcggtccgcttaacccatttaccaacggggattgtcgtcagttcacaagcgcaacgatcacagttgcaaaatagagaaactgcgatgaacatgttgaaagccaagttatatcaaaaagaacaagaagaacaggccaaaaaagcagccgctatcaagggtgaacaactcgaaattggctggggttctcaaattagatcgtatgttttccatccctatacgatggttaaagatcaccggactaattacgaaacaggtaacggtcaagctgtcatggacggcgatttagatccatttatgtatgcttacttgcaatggcaattgagccaaaaaaatccgaattaagtgattcgaatgacgaatgtgtccaaagaatatccaaatggtgtcacagcaatcaaggatttatccgtaacgattgatgctggcgaatttgcctatattgttgggccaagtggtgctggtaaatcaacatttattaagatgttatatcatcaattaaaggccaccagtggtgaaattgaagtggctggttttgatttagtgaacatgaaagatcgggaagtcccttatttacgccgtaaagtcggtgtggttttccaagatttcaaattattgccacggttgacagtttttgaaaatgtcgcttacgcaatggaagtcattgaagctgaacccgaagtcatccaaaaacgagtacttgaagtgcttgaattagtgggtctaaaagccaaaaatgatcgcttccctaacgaattatctggtggggaacaacaacgagttgctgttgcacgggcaattgtcaactatccagaagtcttaattgctgatgaaccaactgggaacttagatccagaaacgtcagaaggcattatggatattttagaagccatcaacaataaagaaacaattgttttaatggcgactcataacagacaaatggttaacgaacggacgcatcgtgtcttagcgattgaagatggtcgtttagtccgggatgaaaaagaaggtgagtatggctatgaagattagatggctatgaagattagaacgttgaagcgccatttaaatgatagttttaagagtttaaagcgtaatggctggatgtcagtcgctgctgtcagtgctgttacagtcacattactattggtcggcgttgtttttgcgatgatttttaattttaataaaatttcaaatgatatcgaaaatgacgtgcacgtccgggtaatggttgaacgtggtacaaccaacgaccagaaaaaccagttagaaaagaaacttaaaaaaatggcgtccgtcaaaaaagtcacttattcaagtcggaaaaaagaattgaataaggtggtcggtagttacggccaatcattcaagatgtttaccggcgacgataatccactttatgatgtttatatggtcagcacaacgaatcccaataaaacgattggggtcgctaaaaaggctaagaaattagcgcacgtttacgacgctacttatggtggcaataatgctaaaaaactctttagcgtgatgaagaatatccgcaaatggggcttaggctttgcagcgttactcttattcgtagctgtcttcttaatctcaaatacgattcggattacgattttatcacggcgtgacgaaatcgggattatgcgtttagttggggcaactaatgcctatattcgctggccattcctctttgaaggggcttggactgggttattaggggtaattgttccggttatcgtaatcgattttggttatgtctgggtttataatcatatggccctcagcatggcttctgccggttactcactcttacgaccaggcatgttcttattccaactcgatttaacaatggctattttagggattgttatcggggccttgggatcagtcgtttcaatgcgtcgtttcttaaaaatctaaatggagatgttcgttaatatgttgcttacctttttcacgacaccattgttatgggtggcgattgtgtttgctttttggttagcgctacatcgtatcaaacatgaacgacagacgtttagaattgccgttaatcctaagtggccagagttgaaactattttggtggcacgggttattagcgggtttagcgctcagttgttgtatcttgttgttaggcgtcacaattaatttaaattggtggttagtctaccaaattgtcgcggtagtagccttatttttgatgccaattggttttgcgggtaacgtcttaatactattaagtgctttattgtatttaatcagtgcaatgatttggccacaatatcaaattctagcgggtaacagtttgctagcagaactgttaattgtagcaggcttaattacaatcctaactggctttttacaaaagtgggatgccactaaggtggtgacaccacacgtcatcactagcagtcgggggcggatgacagcgatgtttacgagccgtcaaatctacttagcacccgttttctttttagtaccaggcactaatcagttacctgattggggcttttggccaatcctacatattggtcagcagtcatttaacatcgtcatcttaccgttgattctcggcttttcagttaaagcgattaaagaattgatgtcagcgttagtgacgcgtgatttgcgaacgcaaatcacatttggtggtgtaattgtggttgccggtatcgttagctttatattcccaagcatcatattgagcacattaagtgttgcgttgattatctgttttatcttacaatggcgattgagacgacaaagccgggcaaataagcaacattttacaaaaccgtatgcgggtattcgtattttgggggttctcgaacaaacaccagctgctaaaatggggttagaagctggggacgtgattgtggaatgtaatggtcaagcaatttcaaacaatgaaaatttctatcaagcgattcaaagccattcgacttattgtcatttgaaagttcaagatcttcagggtgaatatcgcattacggaaagtgcagtttttgccgatgcaccccacgaattaggtgttattttatttccagagaattaaatgaaaacgattctagtggtagacgatgaaccagcaatcttgacactgttgagatataatctggagcaagaacatttcaaggtaatgacggcaacggatggcgcccaagcgctaacgatggccttacagcaaaaatttgattttatcattttggatttgatgttacccaaactagatgggattgcggtaacgaaaaagattcgggaagctaaattaaaaacgccaattatgattttaacggctaaggacaacgaaacggataagattgttgggcttgaagttggggccgacgattacgtgacgaaaccttttagcccccgcgaaatcatcgctcgaattcgagccattgaacgccggaccgctcaaccaatcgaacaaccagttgaacaagcatctgaaacgattgtggtcggtgatttaagtgtggatgaaaccgaagtaatcgcaaaaaaaggcgatcataagttacacctaacgccgaaagaattcgaattattagtgtattttatgcatcgactcaataaggtgcaaagtcgtgaaaaattattaaatgccgtttggggcttcgattatccagccgaaacccggatggtggacattcaagtgagtcatttgcgtgaaaagattgaagatgatccgcgccatcctgtttatctaaaaacggttcgtggttttggttatcaattggaggatcccgcacatgaccaagcatgaatgaccaagcatgatcaagtgagattttataagctagccactattttagtggctatttacatagcctttattttgctcattaatttagtcatttatcgccagcaaagtgcgacactcaaagaacggcgtgccgattacgccttaattgtgaaagacgccgactttaagcgtcaaaaatggctacaacaaaataaattacaagttgtgacttcacagtcgccacagcacaccaagttggaacggtcagtggccgatgttttaaatcgtgatcatactacgcgcaattttagtgttaggcaaaagattgatggccgttggtatttagttgcggttcatcaatcgagtcagccaacgtttgtcttattgatgccacaacaacgcttctggcatacctggccggaaatcgccctgacagtgactgttttgtatctattttttagtctgattgttctctggcaatttaaacggcaacgcagccatttttacgagcacttgaagattttggtggccaatattcatcatattcgctacgaagaaacgccagaaccaattattttccaaaaggacgcgtcattatacgtcctcgcacacgaagtgaaccaattaaacaaggatatgcgtcacatgcgtcaaaagattgccatccaacaaggcagctttgatcggttgattgatcatttaccggtcggagtaatggtgattaatgaaaaccgccaagttgttttgcataacgaggcgatggggcagttattagaaaccgcaatcgagcctcagaagcacccgtatatcgatgatattaagacttatgaattaacgcggatgattgaacatactttccgttatcggcgcagtcatcatcaagagattcaactcattcagaatcgggaacggtttgtcgatgccaatgtggttcagttaaataccgtgaagtctaaatttcaggcactagtgattttgtatgatttaactgatattcgccgagtggaacagatgcagctcgattttgtcagcaacgtcagtcatgaattaaagacgccagtgacggcaattacaggctttgctgaaacgctgttagcgggggccaaggatgatccggaaaccttacagcagttcttgaagattatttatgaagaaagcacgcgcctgacagccttaattcaggatattttggcgttatcacacttggaccgtcaagatcaaacacaggctcaagacattgcgctaaaagcgatggtgacagctaatttagagttgatgcaacaaaagattcaacaaaaagaaattcacgtttccgtcaatataccagagacgttgacgtttaagacgcaaaaaatgaagttaaaccaagtcttgaagaatttgattgccaacggtatcacctataataaacaagcggggtctcttgtgattgcggctcaagtcgatcatcaacaattgataatccgagttgttgattcaggattaggtattccaagtgatttacaagaacggatttttgaacggttctatcgcgttgatcaggctcgggcgacacataagagtgggactggattaggcttagcgattgccaaggaaattaccgaaagtattggtgggcaattgacggttgaaagccaattaggggtcggtagtcagtttattttaaccttccccttaacgtgaatgcgtaaacgtagtgttattggcttattagtcacattcgttgtattactattaactggttgtcaatctaaacaaaatgggcaatcagtcacggcagttgggtcatcggccttacagccattgattgaagcgttagccgaacaatacagtgcccaacattcaggtcagtttattaacgttcaaggtggcggttctgggactggtttaagccagattcaagaaggcgccgttcaaatgggtaattctgatttattcgcagaagaaaaagctggcattaaagcgggcaaattagtcgatcataaagtggctgttgttggtattacaccagtcattaataaaaaaattggcgttaagaatttatcgctgacgcagttagctaaaatctttagcggcgaaattacgaactggcagcaagttggtggtcctgatcaagaagtagtcttggtcaaccgagcacaaggtagcgggacgcgttcaacctttgaacaatgggtgatgggtaatcgcaagacaaagccagcgcaagaacaagattcaactgggatggtccgttcaattgtggccaatacacccggggcgattagttatctagccttttcttatgtggataacacggttgcaacgcttaaactggatggtgttgcaccagatgatcaaaacgttatgaataacacttggccaatctggtcatacgaacatgtttatactaaaggtcaaccaacgggattaactaaggaattcttggcctatgttttatcggataagattcaaaataaacaagttagtaaaatgggttacatcccagtcgcacaaatgcaagttgaacggtcgttagacggcacaattacgaaggttaagtagatggatccaattaaggcaagtttactgaaaaaatcacgggcggcgaaaaccgaaagccgtggaaaattaatcagtttattgtgtatcagtttaatcgtttttatcgttctggctattttttactttgtggcttctaaaggactcgcaaccttctttaaggataaggtcagcctatggcgctttttaacgcaaagtgattggaatccaagtcttaaggatagtcatggtcgaccagaagttggggcgctcccaatgattatgggctcgtttggcgtgacgttcttggcagccttattggcaacaccatttgccattggtgctgggatcttcatgacagaaatttcacctaaacggggcgaaaagattttacaacccgttatggaattactggttggtattccatctgttgtttacggttttatcgggttatcagtggttgtcccaacaatgcgccatatctttggcggcagtgggtttgggattttagccggaacctgtgtgttgttcatcatgattttaccaacggtgacttcaatgaccgtcgacgctttgaagagtgtgccacggcactatcgggaagcatcattggcactaggggcaacgcgttggcaaacaacttggaaggttgttttaaaagcagcgacaccagggattttaaccggggttgtcttcgggatggcacgggcgtttggtgaagcacttgccgttcaaatggttatcgggaatgcggccttaatgccacataacttgatttcaccagcctcaacattaactagtgtcttgacaatgggaattgggaacaccgttatgggctcacttgccaataacgccttatggtcattggcactgctcttattattaatgtcactattatttaacttattagttcgtttaattggtcggaagggagcaatgggtcgctaaatggatgcaaaaaaatgggataaagttgcaaccggcgttttaacactaatcgctggcttaattgttttattattggcaagtttactaggttatatcttaattcgtgggttaccgcatgtgacttggcaattcttgacgaacccagcgtcaacctttacaaaaggtggcgggattggcgttcaactctttaattcattctacctattggtaattgcgatggtgatttccgtgccactttcaattggtgctgggatttacctcgctgaatacgcgcctaaaaactgggtgacaaatgtcgtccggacggcaattgaagttttaagctctttaccatcagtcgttgttggtttgtttggtttcttagtcttcgttattcaatttaaattaggtttttcaattttagctggggccttggccttaaccgtctttaacttaccattgttaacacggaacgttgaagatgctttgaaatcaattcactttacccaacgtgaagcgggccttgcgcttggtttatcacgttatgaaacagttaaacacgtcattattcctgaagcgttacccaatattattactgggatgattttaggagccggccggattttcggtgaagccgctgctttaatttacacagcaggtcaaagtgcgccttcattagatttcacgaactggaatccaacgtatatcgcaagtcctttgaatccaatgcgtccagctgaaacattggctgtgcatatttggaagattaattctgaaggcattatgccggatgcgacagctgtttcagctggtgcatcggccgtcttgattatcgctgtcctattattcaactggttagcacgggtaatcggcaagcgcgtttaccgcaaaatgacagcagcatagatggcagattatgatttaacaaaaacacatatcaaaaaattagcagaacctaaacatgaaattgcgttgtcaactgaagacttaaacgtctactatggtgacaaacgcgcgatgcacgatgcgtcattacaatttgaacgttatcggattacggcgttaattggggcttctggctcaggtaaatcaacgtatctccggagtttaaaccggatgaacgataatatcgctaatactcgtgtgaccgggaagattatgtatcgggatgttgatatcaatagtgacgaagttgacgtttataagatgcgcgaacatattgggatggttttccaacgccctaatccgtttgctaaatccatttacgacaacattacgtttgcattgaaacaacatggtcaaaaagataaaaagtaccttgatgaaatcgtcgaaacaacgcttaaacaagctgcactttgggatcaagtgaaagattcattaaataagagtgccttggccttatcaggcgggcaacaacaacggctttgtatcgcacgcgcaatcgcgatgaaacctgatattctcttaatggatgaaccggcttcggctttggatcccatctcaacaaacaccgttgaagaaacattaattcgcttgaaagaacaatatacaattgtcattgtgacgcataacatgcaacaagcagcgcggattagtgattacactgcctttttccattcagggcacgcgcttgaatttgatgaaacccggaagatgtttacccggcctaagattaaagcggcagaagattatgtgtctggtcatttcggctagttggcgaataaaattattgaatcctcagatgttcatttgttctatggtaaaaatgaggccttaaaaggcattaatatggattttgcagaaaatgaaattacggcgttaattgggccttctggttgtggtaagtcaacgtatctgcggtgtttaaaccggatgaacgatttgattgattccgcaacggtgacgggcaagtttttgcttaatggtcaggatatttatgcgcctgagatggataccgttaaattacggaaggaagttgggatggttttccaacaacctaatccattcccattttcaatttacgataatgttgtttatgggttacgtttatcaggtgtgaaggatcaccgcgttttggatgaagcagttgaaaccagtttgaaacaagctgccgtttgggatgacgtgaaagataagctccacgaaagtgctttgtcactttcaggtgggcaacaacaacgggtctgcatcgcccgggtacttgctgttaagcctaaagtcatcttaatggacgaaccaacatccgcactggacccaatttcgagtacaaaaatcgaaaatatgttgctagaattgcgccaacagtataccattataatggtgacgcataatatgcatcaggcttctcgtatttcggataagacagcattctttttacaaggtgaattaattgaatatgcaccaacgaagaaaatcttcttaaacccaaccgaaaaagaaacggaagattatatcagtggccgttttggctaaatgcgtagactttttgaagatgaattgaatgaactgcacgttcgtttttccgaaatgggcatgatggtcaatgaagccatctataaatctgttaaagccttcattaatcacgataagcaattagcaagagaagtgattgcagacgatcacaagattaatgaacgggaaacggatttggaacgtaagagtttcgaattaattgcacttcaacaacccgtgtcgactgatttacgaattatcgtaaccatcatgaaggctagttctgatttggaacgaatgggcgatcacgcggtctcaatcgctaaatcaacgattcgtgtgaagggcaatacccgtgtaccagatatcgaaaaagatatcgcggatatggccgacaaagtaaaacaaatggtagaagaagtcttggatgcctacgttaaagaggaccggcgccgagcaattgccattgctgaagaagatacagcaattaacgcttattcggaaaacatttacgatgactgtgttaaagaaatgcaacgtgattcagaaacagttgttggcagcatggattacatgcttgttgccagttacttggaacgaattggtgattacgtcacaaacatctgtgaatggattgtttacttaagaaccggtaaagtcgtcgaattaaattcaaacgacaaagaagacgaattttaaatgcaaaagcaaatttacttagcgggtggctggttcacccctaaacaagcagacatggtggcacgcgcccacaaagcgttggcagctaacccaacagttggttatatccatagtccacaagaacatcaatacaaagatgttactgaagataatgatcctaacggtttattcggtggttacgaatgggccaaccaaacttatcaaaacgacatcactgccatggacttagccgatatggccgttgttttatgggatatggctgatgaagatacaggaactgcgtttgaagtcggttatcttaacgcaagccacacaccaattatgtttgtttgtgaagatgacttgcaagaaaatccgattaacttaatgttagctaaaggcattagcaagtgtgtgacggatattaacgaattagaaaccttagatttccaatttgtagcgggcgaaccttatccaggtaaaatcatttaaatgactaaaacgttagaagcattcttgcacgaaggattagcatcattgaaggaacaggggctgtataacacaattgatgttttagaggctcataatggcccaatcattaaaattaacggtcgcgaactgattaatttagcgtctaataattatttaggctttgctaatcgcgatgaattaaaagcggcggatcaagctgctacacaaaagtggggtgttggggctggtgcagttcggccaattaacgggacacttcagattcatcaagatttagaagctaagattgccgaatttaagggaacagaggcggcaatcgcgtttcaatctggttttaactgtaatatgggcgcgatttcagcagtgatgactaaaaatgatgcgatactttcggacgaattaaatcacgcatcaattatcgatggctgtcgcttgtcaggtgcgaagatcattcgtatcaaacatcaagatatggcagatttagaagaaaaagcaaagacggcaactgaaagtggtctttacgaaaaagtgatgtatattaccgatggcgtcttttcaatggacggtgatgtggccaatttacccgaagccgtaagaatcgctgaaaagtatcaactgattacttacgttgatgatgcgcatggttctggtgtgatggggcatgggaaaggcaccgttaagcatttcggcttacaagataagattgatttccaaatggggacgctctccaaagcaatcggcgttgtcggtggttatgttgcggggacccaggcattaattgattggttgaaggttcgtggtcgcccattcctgttttcaacctcattaacacctggttcagcggctgcttgtatcacagcgttagacttaatcatggcccatcccgaatatgttgatcagttatgggagaatgccgattatttcaaggctaaattaaaggcggttggttttaaagttgcaaaatcggaaacaccaattacaccggtaattttaggcgatgaacaattaacccaaaaattctcgcaagcattggttgcaaatggtgtttatgccaaaccaatcgtctttccaaccgtaccattaggaacggggcggattcgtaacatgccaagcgctactcataccaaagctatgttggatgaagcggtgacggtgtatgaaaaagtaggtcgtgaactagggattatctaaatgcataaagtgatggtaacgggttgtttaggacaaatcggatcagaattagtgcctcaattgagagcacaaaacggtgtcgatagtgtgattgcaacggatattcgccgaccagaccataacgaaacggttgaaagtggcccgtttgaagtattagacgtgacagattatgatcgaatgcttaaaattgcaactgattatcaagtcgacacactcattcatctagccgcattattgtcagcagtggctgaagaacgaccacaatttgcttggcagttgaatatgaccggcctcgtcaatgcgttggaggttgcccgtgaattagatttgaaattctttacaccaagttcaattggggcatttggccctagcacgcctaaagataatacaccacaagatacgattcaacgaccaacaacaatgtatggcgtgactaaagtgtctggagaattgctttgtgattactatcatactaaatacggcgttgatacacggggcgttcgttttccagggttgatttcttataagacgttgccaggcggcgggacgaccgattatgcagttgatatctactatgaagctttacgcaaaggccactatgaatcattcattaaagaagggacctatatggatatgatgtatatgccagatgccataggggccatcattaaattaatgaatgccgatccagaacgcttgattcatcgaaacgcttttaacattacggcaatgtcttttgaaccagaacaaattaaagccgtgattcaaaaagaaatgccagattttgaaatgacttacgctgttgatccagcgcgtcaagcgattgcggactcatggcctaatcaaattgacgcgagttgcgccaaagccgaatgggattttgaaccccaatatgatttagaagcaatgaccaaggatatgctggcgcaattaaaaactagaatctaaatgaatgaacgtcaaagaattttagacttagtgaatcaaggtgtattaacatcttcagaagctttaatcttattagaaaatttagctaaaaacgatcaaaatacaaatacaactaaaatgtcagcagaaccagaagtccctgatgttgatgataacgaacaagaatcggcaccagaaactgatcaacgcgcgatcgttgaagaacgcgcaagagaattaacaattgcgctatcaggtgttaaccgccaattacaagacttgaagcaaaaaattcaagccgatcaagaacaagtgactgtgcttgatacaatggaagatttagatagtctgacaagtgaaaaggcggctgaacgccaagcactcaaaacagctgttttacaaaaccaagctcaaattgatgacttggaagaacaacggcaaacattaacggaagaattaaatcaaattgaaaagcaacgtcggcagatggcgaagaatcaatggtctgaaaagctaggcctttcagatgattggaaagaaaatgccagcgaaacattcgatgaaatcagcggtcgtttaggcgaagcaagcttgcatctcggtaaactcatgaaggaaactgctaaaaacgtgatggataacgttgactggaaagaagttaacttcaaggtaccaggtttggcaaccgaaaaattcacgcatgaatttatttactcagacgtgacaccagaaatgattaacgtcaaagtagccaacgggaacgtcgatttcaagatttgggatcaacccgaaattaaagttgtggcccaagtcaaactttacggtaagatgggtgaaacaacagcccgcgaagcttttgaagctcgtagcaacatcaatgtaacagatgctgatttggtcttccaagtccctaacaaacgcattcaagcggacttaacattctacctaccagctaataattacttacaaaccaacgttaagttattaaacggcgatattgcgctagatgggttcacagggcgtgatttataccttaaaacgtcaaatggccaattgacattgaacagtacgaatgtcgcaatgttagaagcagaaaacgttaatggtggaatcaccgttactgacggccactatgaagacattctagggacaaccgtcaatggtaatatcgtgatgaaagcccaagtgttaaatagtagtgtttcaactgttaacggcgatatcaaagcttctttcaatgataatcagttacaacatttgaaagctaagtcggttaatggtacggttaagttggccttaccacaaacgattggcttcacacttgaagctcgcacacgttttgggatgatcaaaaaccggctagccaatgcgcaaacggttgatcaacaccaaagcacagggagccaaatgttacaattagcacgaaacgaagatatgcaagcagcccaattaacattaggcacaacaactggtaatatcttattaaaagacaatgaaaactaaatggcacaaaagagattatataaatcaagagataaccggatgatttccggtgtaatgggtgggatagcagaatacttcaatgttgacgcgacattggttcgagtgctctactgtttgttctcaatcttctcagcagctttcccagggattgtcgtctatattatcttggccctcgttattccggaacggccaagtcaaacgcgtcgcgattctcatgatgaatggagtgaatattaaatgccttttctattaatactagtcccaattttggcgattattctcgccattacggtaatgggcgtcttgattggttcagtgatgattctcttcaagttcgcaattccgttactagtgatctggctcatttaccgcttaattgtcggtcataataaaccacgtcaccattaccacgaacaacaacatcaagcctattacagccaaccgagcgattctcgggggcgtaaggaagcacgtgatgtgaaggtcgatgatgacaactggagtgatttttaaatgcgctattggacccgcgttttagtgaatacaatcttatttatcgcaatttcgggcttactaccaggactgtttcatgttgacggtattttagtcgccttagtggcaagtattgtcttatcaattttaaacgtgctagtaaaaccgattttgcatattctctcatttccaattacgtttttaacactcggccttttcagcttagtgattaatgggattatgttggaattaacgtcaatcttcgtcagttcagggagcaccttcccgaacgtcacatttggcttttctggattaggcgcggcgattgtcgtggcgttcatcctatcgattgccaatacgatcattggcaatcaatttagcagagagcgttattaaatggcggatagtgtttcaatggaaagattagtgacggaccttaagttacaagtgtactcaggggaagctcatttaaaagagaaaacagtgacgttgagtgatatctctcgtccgggactcgaattaactggttattttaattattacccatacgaacgaattcaattatttgggatgacggaagtttcttttacgcaaaatatgacggcggaagaacgcttaatgattatgcggcggatggcttctgaaaatacgccttgtttcttaatttcgcgtagtttagaaccacctaaggaaatgttacaagcagctgaagaatctggtattccagtgttaggatcaaacctatcaacaacccgtctttcaagtttagtgacggattatttagatggtcaattggctgaacggcgctcaatgcacggtgtcctggttgatatctacggtttgggggtgctcatcacaggcgattctggtgttgggaagagtgaaaccgcacttgaattggttaaacggggccatcgtttaatcgcggatgatcgagttgatgtttaccaacaagatgaacggacggttgttggtgaagcaccaatgattttgcgacacttacttgaaattcgggggattggcattatcgatgtcatgaacctctttggggctggtgctgtacgggctgatacatcaatttcattgattgttcatttacaaaactggtcacaagataagaagtacgatcgtcttggttccgatacagaagaacaaatgattttcgatgttccagtacctaagatcactgtgcccgttaaggttggtcgtaacttggccatcatcattgaagttgcagcaatgaactttagagccaaatcaatgggctatgatgcaacgaagactttcgaagcgaacttaggcaagttaatcgaatctaattctgacgacgaaaactaagtgaacctaatattaggtgttttaaatccgattgccctacaattagggccgttggcgattcattggtacggcgtgattattgctagtggtgtcgtattggccgttgtgttggccttgcgagaagctaagcgccgcaatgtcagtgaagatgatattttgaatttaattttatgggccttaccgtttgctttgattggggcacggctttattatgtgatttttgaatggtcctattaccaagccaatccaagtgaaattattaaaatttggcacggtgggattgcgatttatggtggtttaattgccgcaacaattgtgttcatcatctattgtcgcaagcatttcttgtcgccgtggttagttttggacatcgcggcaccaacggtcatgattgcccaagcaattggtcgctgggggaattttatgaatcaagaggccttcggggctaaaacgacgttgcacttcttagagacacttcatttgcccaattgggtgactgatcagatgttgattgatggtgcttatcgccaaccaactttcttatatgaatcgacttggaatgttttagggtttataatcattatgagtgtccgtcatcgtcaaggttggtttaaacaaggtgagattttattgagctatatcgcttggtacgcctttggccgctttttcgttgaagggatgcggactgatagtttatttatcggaccattacgtgtgtcacagattctatcactcgtgttgttctttggcgcgattgggctgtggatctggcgccgtaaacaacagacgttacccgactatttagaaggtaatacactgcgttcagcagttaaataaatgacagttaatgttgcagttttaggtgccggttcatggggcacaattttagccaacttattagtagaaaatggccaccacgttgaattatgggggaatgatcctgagaaagtagcagagattaacgaacaacacactaacaagcattatttacccgaattcaagattgatccacgcttacacgcaactttagatttaaacgaagcgtttgaagcagtggacgttgttttattcgttattccaacgcaagtcattcgtctagtggcagaacaaatcgtgccagtgctagaagcaaaaggggttaaacccgtgattgtcacagcttctaaagggttggaacaagggagtcataaacgaatttcagaagttttaactgaaactattccggcagatgttagaaatggcatcgtggtcttatcaggtcctagtcatgctgaagacgttgcaatgaaggatattacaactctaacggctgcttcaactgatttagtgcaagctcaatggattcaagaaatcttcatgaacgattacttccgcctttacacgaatacggatgtcatcggtgttgaaatgggtgcggctttgaaaaacgtaattgctttaggcgcaggtgcattacatggcttgggttatggcgataacacgaaggctgctttaatgacacgaggcctagccgaaatttctcgtttaggggttgccatgggtgctaacccattaacgttcatcggtttatctggtgtcggcgatctcatcgtcactgggacaagcgtgcattcacgtaactggcgaacagggaatgctttaggcgaaggtcaaaagctagatgatgtcctagaaaatatgggcatggttgttgaaggggtcgcaacatgtaaggccgcttatgaattagcacaacaacgctcagttgatatgccaattaccaacgcaatttacaacgtcctttatcgtggttgtgacattcgcaccgaaattggtaatttaatgcaacgttctggtaaaccagaaatcgattttaaatagatgggcgatttggtatctgtaagaccaacttgtgaattttattttgacagagggatgcaagcatttgagcgatttcattatgaaaaggcgctcacttgcttgcaacgctctaagtcactggcaaaaacgaaggatgattacatcttcgtggtttgccagttagcaatttgtttagaatcggtcggtaattaccgtggtgctgtgattgcactggaagaaattccaagtgttaattaccagacacatccggaattacagtattttttagcaacggcgtatgcttttttagggcagatgcaagagagctatcaattagcgaaagcctatttacaaagtgatgactcagattttgaagctgaggcaaccgaactattacaagaattgaaacaaattaaaggttaaatggctaaaagttatgatgtaattgtaattggtgctggccccggtgggatgacggcggcgctttatgcatcacgttcgaacctatctgttttaatgttggaccgaggaatttatggtggtcaaatgaacaatacagcagaggtcgaaaactatcctggctttaagtcaattttgggcccagaattgggcgaaaagatgtatgcgagtgccacacaatttggtgctgaatacggttatgggacagttaatagcatcgaagacaaaggtgagtttaagttagtccataccgatgaaggcgacttccaagcacgggccgtgattattgcaacaggttctgaacataagaaaatcgggattcctggcgaagatgaatacggtggccgtggtgtctcatactgtgccgtctgtgatggtgcgttcttcaagaacaaggaagtcgttgtcatcggtggcggtgattcagcgattgaagaaggcctttatttaacacaattagctagcaaagtaaccgttattcaccgccgtgatcaactacgtgcgcaaaagattttacaagatcgcgcatttgctaacgataagatggcttttgtctggaatgcacaagttaaaaccattgaaggcgacgataaaaaagtagctgctgttacttatgttgataaggaaagtggcgaaactaaagaagtaccagcaagtggtgtcttcatctacgttggtattgacccaatgacaagtgctttcaaagacctaggtattttaacggaagccggttgggttaaaacagacgaccacatggcaaccagtgtccctggaatctttgcaatcggtgatgttcgtgaaaaagacttacgtcaaatcacaacagcagtcggtgacggcggcatagctggtcaagaagtcttcaaatatattcaaagtatttaaatgagctggcaagataattatgcaatttggaataatcaaacaaaaatggatttacctttaagagaagctttagacaatatggcaaacgatgaagaagcgcttgaaaaagccttcagcgtgccaatggaattcgggacagctggtatgcgtggtctcttaggccctgggattaactgcatgaatatttatacagttcgtcaagcaacagaaggccttgcccaattcatggaaactttaccagaagcaactaaaaaacgtggggttgcgattagttttgattcacgttaccaatcagaaacttttgcacacgaagcagcacgcgttttaggccaacatcaaattccaacattcgtttttgatgctttgcgcccaacacctgaattatcatttacggtccgtcacctacatacttatgcaggaatcatgattaccgctagccacaatcctaagcaatacaacggctacaagatttacggcgaagatggcgctcaaatgccacctaaggaatctgatatgattacaagctatatccgtcaggtatcagacctatttgcaattgaagttgctgacgaaatggccttacgcgaagccggcatcatggctttaattggtgaaaatgttgatcaagcttatttagcagaagttaaaaaagtaacgatcaaccaagaattagtggatactgttggtaaaacaatgtcattaatttacacaccacttcatggtactgggaaagtccttggtgaacgtgctttacgtcaagcaggcttcgaacaattcacaatggtggccgaacaagccgttgctgatccagaatttgcaacaacaccattccctaacccagaattcccgcaaacttttgatatggctatcgaacttggaaaagcgcaaaaagcagaccttttaattgcgactgatccagatgccgatcgtcttggggccgctgtacgccaaccagatggtagctatcaattaatgacagggaaccaaatcgcatctgttttacttcgctatattttacaagcaagtaaagatgcaggaacattaccagcaaacgccgctgcagttaaatcaatcgtttcaacggaattggcaactaagattgctgctagttacaatgttaaaatgatcgatgtcttaacgggcttcaagtttatcgcagagcaaatccaacattttgaagatactaatgaaaataccttcatgtttggttttgaagaaagttacggctacttggttaaaccattcgtccgtgataaggatgccattcaaacgctggttctattagctgaagtggcagcttactacaaatcaaacggtaagacgttgtacgacggtattcaagaactatacgctgaatatggctactatgctgaacaaacgacagcgattgattttgaaggcgtcaacggcccacaacaaatggctgacttaatggttaagtgtcgtgaagaaagtcctgttgattttgccggcgtcaaagtcgcttcagcagaagacttccaaacacaaacgcaaacatttgctgatggtcacactgaaccaatcaatttaccaacatcaaacgttttgaaatatcacttagaagatggcacatggatcgcaattcgtccaagtggcacagaacctaaggttaaattctacgttgggacttgtgctgacgatgaagcaacggctgatttgaaattagctaactttgaaaaagcaattcaagaccttgttaaataaatgggtatgcatcagtatttgcaagggttaaataatttggagacactaaaccgggcaccaggattatttaagtatcaggaacattccgtcgcagcgcattcatttaaagtttgcgagattgcgcagttactaggcgatatcgaagaagaaaacggccaaccaatcaattggcaagtcttatacgaacgggcgttgaaccatgattatacggagcgttttattggggacatcaaaacacccgttaaatatgcgacgcacgagttacggacgatgttagccaatgtcgaaagttctttaacggataacttcatcaataatgaaattcccggttttttacaagaacgctataaacggcgcttgagtgaaggtaaggatgaaactttggaaggccaattattggcagttgccgataagattgatttgctttatgaatcatttggcgagattgaaaaggggaatccagagaatgcctttttggaaatttttgcagaaagcttgaaaacgattatgcaatatcaaaatttgtcgagcgcacaatatttcatccgaaaaatgttgccagacctattgagtgaggattttgccgaccgtggcaagctcacacaattggtgcgccaaacgttgtcaaactagatgattgatagacagaacgataacctatttgacttagtcgcaccatatgaacctgctggcgatcaacctgctgcaattgaaaccttaacgaagaattttgaggcaggtgctaaggcgcaggtcttgatgggcgctactgggaccgggaaaacttttacaatgtccaacgtgattaagaatctcaacaaaccaacgttgattatttcgcataataagacattggccggtcaactgtacgcggaatttaagcagtttttccctaacaatgcggttgaatatttcgtgagttattatgattactaccaaccagaagcctatgtgccttccagtgatacgtatatcgaaaaagattcgagtattaatgatgaaatcgataaactacggcattcagcgacgagttcgttattagaacgcaacgatgtgattgttgtggcctctgtttcttgtatctttgggttaggggatccacgtgaataccaaaatcacgtcttgtcactgcgtccaggaatggaagttgaacgtaacgacctattacgtcagttagttgatattcaatttgaacgtaacgatatagattttcaacgggggcgctttagagtgcgcggtgatgtggttgaaattttcccagcttctcgtgatgatcatgcgctgcgcgttgaattttttggtgatgaaattgatcggattgttgaagtggatgccttaacgggtgaagtgattggcgaacggtcgcacgttgccattttccccgcaacgcattttatgacgaatgatgaaaaaatggaaaaagccattgaaagtattaaagctgaattggctgaacggctagctgttttaaagggcgagggtaagttactagaagcgcaacgccttgaacaacgaacaaactatgaccttgaaatgatgcaagaaatgggttattgttctgggattgaaaattactcacgccatatggaagatcgccaagccggcgaaccgccttacacgttgctagatttcttcccaaaggattcaatcatgatgattgatgaatcccatgttactatgccccaaattcgggggatgtacaacggtgatcgtgcgcggaaacaaatgttgattgactatggtttccggttaccaagtgcgttagataaccgcccattaacgttgccagaattcgaagagcacgtgaatgaaattatgtatgtgtcggccacaccagggccttacgaagcggaacaaaccgatattcaagtggatcagattattcgaccaaccggcctgttggatcccaatattgaagtccgaccaattatgggccagattgacgatttagtcggtgagatcaatgaccgcatcgaaaagaatgaacgggtcttcattacaactttaaccaagaagatgtcggaagatttaaccgattatctcaaggaactgggaatcaaagtccggtacttgcacagtgatatcaagacgttggaacgaacggaaattatccgtgatttacgactgggcaagttcgatgtcttaattgggattaacttattacgggaaggaatcgatgtgcctgaagtatccttagtggcgattttagacgcagataaggaaggcttcttacgtagcgaacgttccttaatccaaaccattggccgggcatctcgtaatgaaaatgggcaagtcttgttgtacgccgataagattacggattcaatgcgtcacgcaattgatgaaactaaacggcgacggacaattcaagaagactacaatacagctcataacatcacaccgaaaacgattattaaaccaattagagatgcgatttcaatggttcaatcagttgaacatccagaagaaattaagatgaccaatgagattgatctagagaacatgtcgaaggctgaaaaactagaaatggttgaacgactatccgaacagatgcgcttagcagctaagaaacttgatttcgaacaagcggcgacattgcgggataccattttagaattaaaaagtgaaatagattagatggcaaatgataagatagtaattcacggcgcacgcgcccataatttaaaggatatcgatgttacgattccaagagataagttagtggtcatcaccgggttatctggttctgggaagagctctttagcatttgatacgttatatgcagaaggacaacggcgctatgttgagagtttatcagcatacgcgcgtcagttcttagggcaaatggataagccggatgttgattcaattgacgggttaagtccagcgatttcgattgaccaaaagacgacctctaaaaacccacgttcaacagttgggacagtcactgaaatcaatgactacctccgcttattgtgggcccgagttggtcaacccatctgtccaaatgatggtactgaaatcagtagccaatccgtagaacaaatggttgatcgggtattggctttaccagaacggactaaactccaaattatgtcaccgattgttcgtggtaaaaaagggcaacacaaaaaaatcttcgagaagattcagcgtgaaggctacgttcgtgtccaagtggatggcgaagtaatggatgttagcacggatttagaattagataagaataagaaacatgatatcaatattgttgttgatcgaatcgtcgttaaagacggtgttcggtcacggttatttgattcgtttgaagcagctttgagactatctgacggttatgcgacagctgatgtgattgacggcgaacaactcttgttctctgaacattatgcttgtccaatctgtggctttacggttggggcattagaaccacggctgttctcatttaatgcaccatttggggcttgtcctgaatgtgatggcctaggtttaaaactagaagttgatacggacctcgttgtcccagatacaagtaaaacattgcgtgaaggggcgattgcgccttggaatccaatcagttcgcaatattacccacaaatgttagaacaagcttgcacggcctttaaaatcgatatggaccgtcctttcagtaagttgacacctcgccaaaaagatatcatcttaaacggctcacaaggcaaagaattccacttccattatgaaaatgattttggtggcgttcgcgatgttgaagtgccttttgaaggggtcttcagcaatattgaccgtcgttatcgtgaaacgaatagtgatttcacacggacgcagatgcggacctatatgacggaattaacgtgtcaaacgtgtcacggtaagcgactaaatcgtcaagccttggcagttaaagtcggtggacaagatatcgccgaagtttcagacaatgcaatcaaggatggcctcccattctttgacaatcttgaactttctgaaaaagatcaagtgattgcgaaacccattttgaaagaagttcatgatcgcctgactttcttgattaacgtcggcttagactacttaacgttgagtcggtcagctgggacactttccggtggggaagcacaacggattcgtttggccacacaaattgggtcgaacttatctggcgtgctttatatcttagacgaaccttcaatcgggttgcatcaacgtgataatgaccgtttaatcggttctttgaagaagatgcgcgatttagggaatactttaatcgtggttgaacatgatgaagatacgatgcgagcagccgattacctgatcgatattggcccaggtgctggggatcttggtgggaaagtgatggccgctggcacaccaacggaagttgaacagaatcccaattccttaacgggtcgttatttagcggggcaggattatattccggtaccgttaaaacgacgtcaagggaatggcaaaaaagtgcgcgtaactggcgctgccgaaaataatttaaaagatttaacggttgattttccattaggtgaatttatcgccgtgactggtgtttctggttctggtaaatcaacattagtgaatacgattttgaaaaaggcccttgcgcaaaagatgaatcgtaattcagctaaaccgggtcaatataagaccatcacgggttatcaaaaccttgagaagttgattaatatcgaccaaagtccaattggccgcacaccacggagtaacccagcaacttataccggtgtcttcgacaatgtccgagatttattcgcacaaaccaatgaagcaaagttacggggttacaagaagggccgctttagttttaatgtgaagggcggtcgctgtgaagcctgcaagggtgacgggattatcaagattgaaatgaatttcttaccggatgtctatgtcccttgtgaaatttgtcatggtagtcgttataattcagaaacgttagaggtggtttacaaaggtaagaacattgctgaaatcttggatatgaccgtttctgaagcaactgaattcttcgaaaacattcctaagattgctcgtaaactacaaacaattgtcgatgttggtttaggttatgtgacattaggccaatcagcaacaaccttatctggtggggaagcccaacggatgaaattggcttctgaattgcaaaaacaatcaacgggtaagaatttgtatatcttagacgaaccaacaacaggtttgcatacggatgatattaaacgattgttaggggtcttagaacggttagttgatgagggcaacactgttttagtcattgagcataaccttgacgtgattaaaacggctgatcatatcattgatttaggaccagaaggtggcgacaaaggtggtacgatcgttgcgaccggcacacctgaaacattggtgaacgtcgcagaaagctacacgggacgttatttgaaaccaattttagaacgtgatacagcgcgcacactagcggcacaagaatgaatgtttagaagaaatgattggcgatttgattggtcagaattaatgaccgggattattttcctaattggggcgtacttcttgttaaataagccgaaagcaacattatctggcttagtcatcattgtggcggtggctgcgattattcggggaattgctaaaattagtgtttacggacaattaagacaagatactggtattcgggcgaccgtgatgttggtcaatgctattttagatattgtcatcgggttattattcatctttaatatcccagccggcatttttacaatgagttatatgtttgcaatttggttcttgctagatgcaatcgtcgggttattaaatgtaagtcatttgaagcaatttaacatgggcttgtatattctatcgattatcttaaacgttttaggattgatcgtgggcttattattattaatgaatccagtggtggcagctgtgacgatgactaccttattaggtttttacttcgtgattgttggaatcaacgcgattgttatcgcgattgcgcgtcggttataaatgacagatacgttgaatttagtagtaattactgggatgagtggtgcgggtaaaaccgtcgcaatgcagagttttgaagatttaggttatttctgtgttgataacatgccaccttcattgttacccaaattttgggaattagtgaaggaatccggtaaggtaacgaagatcgcgttagtgatcgatttacgttcacgcgccttttacgatgggattattgagatgctttctggtcttgataatacgcaatttgtcacaactaagattttattcttagatgcttctgatgaagaacttgtttcccgttacaaagaaacgcgtcgttcgcacccacttgcgcgcaatggccgtttgatggatgggattcacaaggaacgtgaattattaactgaaattagaaaccaatctcaaatggtggttaatacatcaatgttatcacctcgcgaattacgggaacagattttccgggtctttaagacctctgataatccgtcatttcatatcgaagtgatgtcatttgggtttaaatatggcttgccaattgatgctgatattgtgatggatgtgcgctttttgcctaatccatactatgttgcggaattcaaagcgttaaacgggttggataaaccagtccgagattacgttatggaacaacctgcaacagaaaaattttatcaacaattgacagcactattgaaaagtatcatgccaggttatcttaaagaaggtaaaacaagtgttacgattgcaatcggctgtaccggtggacaacatcgctcagttgcattagcacaacgtttagcggatgatttagccgttgactatccagttgatgtgacgcatcgtgatatgaagaaacgaaaggaatcggtgaaccgctcatgaatgacagctactaatcgcattatccgggtgattaaaggtcgtcgtcccaaggtggttgtgattggtggtgggacgggactccccgttattctaaaaagtttacgtgaacaaaatgcgtctgcgaccgccattgtaacggtcgcagacgatggtggttcatctggtgttatcagagattatattaacgttgtgccacctggtgatattcggaacgttttggtggctttatcagatttaccacagttaacgctcgatatttttcaatatagatttaaatcacatgatgccttcttttcagggcatgcaattggtaatttaatcattgcggcgctttctgaaatggaatctggcatctttgatgcggttcaacgactttcagaaatgatggctgttgatgggcatgtttacccggccgctaatgtggccttaacgttaaatgcggcctttcaagatgggacacaactggcaggtgaatctgaaattaccgcagcgcgcaagcaaattaagcgcgtttgggtgacgaagacggatcctaatgatcaagaggaaccaaccgcagttcaagaagttgtcgaagcgattatggcagccgatgttgtggtccttggaccaggaagtttgtttaccagcattttaccgaatttaatgattaaaaatcttggtgaggcagttaagcaaaccaaagccgagattatttatatttgtaatattatgactcaaaaaggtgagacagaacgcttcactgatgctgaccatgtccgggttttgaatgaacatctagggcaacatgtggtggatacggtccttgtcaatactggccaagtgccagctaattatttggatcatcaaaaatatgatgaaattttatggccggtcgaacatgattttgacgggctgagacaactaggttgccgagtgatttccgataattttttaaaactcgacaatcacggtgtcttccataatggtcaaaaggtcgcaagtgaaattatgaatcttgcctttcaggttaatacaactaagcgaggtgaataaatggcttcatacgcaagtgaagtaaaaaaagagctaacgcaactcgaagtacatccagaacatgcacgtgctgaattggccgctttaatcagaatgaatggttcattaagcttgatgaaccatcaatttgttttgaacgtgcagacagaaaatccggcgatcgctcgccggatttatagtttattgaagcaaaactatcaggttgaatcagagttattggttcgccgtaaaatgaaattaaagaaaaataatcaatatattgtgcgactcaaatatgatacaaacacggttttaaacgacttaaacatcgttgctgaagatgggtttaccattcatacacgagtgtcagaagatatcattgatgaagatcagcgcgtacgttcatatctaagaggcgcctttttagctggtggttcggttaataatccggaaactagtcggtaccacttagagatttattcactctacgaagaacacaatcaagatattgtgcggatgatgaatacgtttgggctaaacgctaaaacgacggttcgccgcagtggttacatcacttatttgaaagaagcagaaaaaattgccgatttcttacaggtgattggtgccacgaatgcgatgttgaagtttgaagacattcgaattgtccgtgacatgcgtaattcggtgaaccgtttggttaactgcgaaacagccaatttaaataaaacgattgatgcggctgcgaaacagattgaaaatatcgagtatttaagggattcagtaggactagataatttacctgcgaaattgcgggaaattgcattattacggttggaatttccggacattactttgaaagaacttggtgaaaagatgccgagtggggcaatctcaaaatcagggattaaccatcgtttaagaaaattaaatcaattggctgaaggttaccaacagaaagtcatttaaatgattaaaccagtattattagatgagcaattatgcttttcgatttatcgcgcacagaaagcttacaaccatttttacggaaaggtcttaaaaccttatggcttaacttatccacaattcatcgcaatgttagcattgtgggaacatgggacaatgtcagttaaggaattaggtcaccatttagaattagatagtgggacattaacaccactattgaaacgcctagaagcggatggttgggttgatcgtaagcgcgcatctgacgatgaacgtcgcgttgatgtttcattaacagatcaagcagaatcacaaaaacttgaaatctacgaacgtgtcggtaattgtaccaactacctagatttcacaagcgacaaatatcatgacttacgtcaaagcatgaacgaagtcgaaaaacatttaaatgctattcaatcagacactgatcgatttgcttaattaaaatttcttttttttgctgagcaaaagatatacaaaaaattttaaatttgtacacataaacagcgaaagcatctgaatttcactacttcgtatgcttaacgtataattgattggcatgactgttggcagaaagtaatcatgcaaaggaaaatgccagccatagttaaggtagctaagtgagggatagggagaaattataaaattaaaaaataaaaaaatgtttagtgttaaaaacatgtacttataatacctgtacaattgtgtgcgcttttgaaggatgtaaaaaaaagcgattaaacacaagaaaatgatgataccgtaatccactatggtaaaactactgggtgcatcaggataatttaacgttgaaaaacggtaaaatttgcgcaaccaaatattgaagactgtcatagtgataaagaaaccaaagaaggctattctaactttaggaaatgctggtttagttttatcttttattaattgaggattaagttttctttgatccatttatttagcttgtaaaatggtatcgagttcttctggtgttattgattcatcaaagatgtgttcaccagcgatgattgttgggacgaatttgatattggctgcttgagcttcgtcaacaatggcagctaactgcacggtattatcaagtgggcttagtttaaggttagcctgcatgtatttatcgaattcagaatccgataaatcagggcgccacgttttttgatgggtgtagagaaaatggatggcatttaaagcaacagcgggttgatcgaagggtaggtaagtatgggcgaggttaccgattaatagatcatctttatccttgttataaggtttgatgattcgtcgtacttgaccagcttcgacggccttagtgagctgttcctccgatttgaggaaccatttgcgacaataggggcaagctaaattcaaaaattcaacaagtgtgacgggtgcttcagggcggccaatgacaatcccaccttcagttgtcacttgatcacttttaataacactaatatccatctattttggttggttaaccataatgtcgtcaatcaaaccgtaatcttttgcttcttgggctgtcatgtagttatcacgatcagtgtctgcttgtaatttttcgaagctttgaccagaattatctgccaagatttggttcaaacgtttccgagtcttcaaaatttcgcgagcagcgatttcgatttcagtttgttggccttgtgcaccacctaaaggttggtgaatcaagaccgttgagttaggcaatgcaaaacgtttgccttttgtcccagctgaaagtaaaacgctggccattgaagcagccatgcccatagcgattgtttgaacatcagatttaatgaagttcattgtatccatgattgccaaaccggctgtcacagaaccaccaggtgagttgatgtagattgaaatatccttatctgaatcttgcgcatccaagaatagtaattgcgcaatgattgtgttagccatttggtcgttcacttcaccagataacatgatgatccggtcttttagtaaacgagagtaaatatcgtaggcacgttcgccacgagatgtttgttcgataactgtcggtactaacatttaagcatcatattccgccaagtcatagtcttggattgcttttttaattttagttgcgtagttaggatcagtggcatagccagccttttgtaagagatcggcttgttccgtataattagtgaggttggtgagtgtcgcgtaagtgccaacactcagaaaatcactgtgatcttgaattgcgatttcaagagaagggtaaactttgaagtaatctttaatcgttgttcgttgattattttcgtattcgtcggtgttcattaggatttgctggccctcatactgacctttcaccccaaagaggttattggccttggttgccaaatcgctgcgtccccagtcagactcgatgatggcttgggcgataataatgctaggtaaaacctgatgctttttttgatagaccaatttagcattttgaccgatttttttaatgaagcgactttgtcgttgttgttcttcttgattagtttcccaggttcgagcgggtgcttgactgctttgatgtaggccacagccagtcagtagcactaataggccactgaagactagtccgatccgtattttagacgtgattgttgccaaatgacacacaaaatgattttagatttagatactgggattgatgatgctttggcggttgcctatacattgggttcaccagaggttgaattaattggcattacctcagaatatggcaatgttttgacggaaagaagtgtcgtcaatagtcaacaaatcttacatttattgggccatccagaaatccctgtttatttaggggctggtcattctacgacgactaacgactttagtgtgttaccaattagtgcggaaatccacgggcaagatggggtcggcgaaatacatttaacacaaccgcatgcggatgccgctagtcaatcagccgttgattttatactagctgcttgtcaacagtatggggctgatctcagcattgtcgcgactggcccaatgacgaatttagcattagcaattaaaaaggatttaccaatgcttcaaaaagtaggacaaattgtcatcatgggtggcgcgctcacagtttgtgggaatgtttcgccatatgcggaagctaatattagtcaagatccagaagcagctgatttacttttcaagagtgggttaccagtcacgatggtcggcttagatgtgacactcagaacactcttcactaagacggatacccaggaatggcgggaacttgcaacggatgcggccaaagcctatgctgatatggttgattattatattaaggcgtatgaagtaacatcacctcatttacatggttgtgccttacatgatccattagcagttgcggtagcaattgatcccagtctcgtgacaaccttcccattgaatctgaaaacagaggtcgaagggccttcacgaggtcggacaatcggggataatgcccggttggatgatccggaaacgagaacagctgtctgtgtccaagttgatacaccacgctttttagctgagtttaaaacacggattgggcaactcttaaaagtagcgaaataaatgaaaaaggttagtcataagaaattgcttaggcggacattatatgtctgtagtggcacgttgttattactgaatagtggtgttggggtggcgagtgtctttgtcatcaatcaaaatcgggcgcaagcgagtcaggtgaatccacgggccggcttagctgatatttcgattttgcaaaatgcgagtttgacctcgacaacggggacgcaaatgacccctaatgcacagggaaactttgatttatcgttaaattatacggggcaaggtgttgcaacagtgggtgttgcggataaaaaggttttggtttacgccttacccgcttcgcttcagggtaaagtcgttggtggtagtacagttgatattcaagctgatctattaccatcaccccgggtgatatcccaggtgttaagccgttatttgatgcgttgggattagttggataaggcattaaaaattccagcagttgttgcggccttcaataatcttaagaaagttcaagatttaggtagttatcaagaaacggttactgctaacgtttctcctgatggtaaaacaatttcagtcgactttacgcaaggttttggtcgttatgtgcatcaagcctatgcggcattatttgacactttgcgggatgcaatcgcagccgttcattcggacaatatacttatcgaggctttagtgaaagcgcttcaaaaagtgagtgcagatctttttgcaattattgatgccattgccgggggcacgtcgacaattttagatagtgctttgagtggtaatttattaggttcggctagcggtactttgcataccacagttagtgatccgggtgtaccaactgctacggttaaagcagctgcgattaataatgccttaatttcagcagatattttgacggctattgagcaagaaggggaagcagtaacgttgaatttcccaacgactgcgactaatccgattgaaaattatgatgtggcgacaccaacggtaacccaaccagtagctgggcaaacaacagttgctgggaacgtcattttaaaagaaccaattccagatggcaccactttcgaagcagttgtaacacttgatgatggtacaactaagactgcgacagtgcaggctgatgggacattcgtcgtggatacgggggctttaacagccggtcaaattttatcgacaaaagtggtggcaactaacggccaatatacaaaagaaagtacagcggttgaatcaacggttagcgatgtttcaactgagaatccaattgaaaactatgatgtggcaacaccaacggttaatcctgcgacagcaggcgatacgaaattggatggtcaggtgacattaaaccaaccaatcccagatggcaccacctttaaagccgtcgcaacactagctgatgggacggaagtcagtggtgacgtcgacgtaacgaccggcaagtttagcgtgacaaccgatccattagtcgccggtgatttaaaagtgaaagtagtggcgactaatggacagtatacaaaatcgagtacagacgtgacggtaacagttgccgctgcaccgattgaaaatccaatcgagaactatgatgtggcatcaccgacagttgatcctgcgacagcgggcgatacgtcattagatggacaagtgacattaaaccaaccaattccagatgggacaacctttaaggccgtcgcaactttagcggacggaacggaagtcagtggtgatgtgaacacgacgaccggtaaatttagtatcggcactgatccattggtagctggggatgtgacggtgaaaattgtcgcgactaacggtcagttcacaaaatcgagtacggacgtgacagtaacagttgctgatgcgccgattgaaaatccaatcgagaactatgatgtggcaacaccgacagttgatcctgcgacagcgggcgatacgacattagatggccaagtgacattaaaccaaccaatcccagccggtacgacgtttaaggccgttgcaactttagcgaacggcactgaaattagtggtgatgtggacacaacgaccggtaaatttagtatcggcaccgatccattggtagccggagatgtgacggtaaaaatcgtggcaacaaacggtcaattcacaaaaccaagtgcgaatgtaacggtgacggttgctgatgcaccaatcgagaatccaatcgaaaactatgatgtggcaacaccaacagttgaaaaatcttttgctggtgatacgagcgttaagggtcacattgacttgaagacgccaattccagataataccacttttgaagcaacggtgacacttcctggtggtcgtcaagttaaggcggatgtgcaagcaaacggcgattttacagttaatacagaagatccgctagttgcgggtagtcaattagccatccatattacagccattaatggtcaatttaccaaagaaggggccgcgatcaactcaacagtggccgacgcactaccaactgatccattagttaattatcaagtgacaactccaaccttggattcagcaaccgatgggcaaactaaggtgagcgggcatgtaaacttacaggtcccaattccagacggtacaacgtttaaagctgaagtacaattacctgatggggcaactgttgcggctgatgtacaggctaacggtgattttgaaattccaacgcgggtgttagttgcgggtgaaagtttatccgtgaaagtaatcgcacaaaatgggatctatcaaaaagaaagtgcaccagcctcattattggttagcgaagctgtaccaaccaatccacttgaaaattatacggtggccacaccggatgttaatccgatgacaactgatgatacacaattaacagggaaagtaacactaaccgatataccagctggcaccacttttgaagctgttgtgacaatggcggatggtagcaccaaacgcgccaatgttagtccagagggtcaatttacgattgaaacgggtcaattagcggctgatgatgttctagcggttaaaatcactgctaaaaatagtggttataccaaggatagtgcttcagtcgacgtaacggttacccaagcaccggatacgaatccattagctaattatacggttgctcaacccgttgtagatgctgcttctgcaggtgatacgacagttactgggaaggttgatctaactacgaacccagcaccagccggcacgacttttgaagcaacagtcatgttaccagatgggacacttaaaacggctgaagtagcagatgacggtacttttacggtcacaacgggtgaattaaaggctgatgatatattagaaattcatatcactgcccataatagcggctaccaaaaagacagtaatccagttcaattaaccgttgatgcagtagtcgaaacgaatccgcttgaaaactatacggttaatgcaccagtcgtagcaccattaactgaaggcgatacggcagttaaaggccaggttaacctaggtattccgattccaaatgggacgacttttgaagcgattgtgacacttgcagacgggaccactaaatccgttgcaattggtgcagatggtcaatttaccgtaccaacggaggccttagttgccgatgagacggttgctgtaaaggtggtcgcaactaacggtacatttaccaaggatagtagtgtcgtttaccaaaaagtgagtcaaaaattaccaacggatcccattgcggattacgaagttgggacaccaacagttgacccggtaacggctgatcaaacgagtgtcactggtcaagttgtgcttgcagaaccgattccagaaggcacaagttttgaagcaacagttaccttagctgacggcacgcaaaaaacagccacagttgatgaaaacgggcactttacaatcgtgaccggcaacttaactgagggtgatcaactaacggttaaggtaaccgctaaaaatagtatttatactaaagatagtgcgctagtaacggtcaacgttggtccggcagttgaacaaaatccactcgctgattacgatgtcaatatgccagtattgaatccggctaaagcgggcgaaacacatgtcagtggctctgtgacattgaaacaaccagcaccagcaggcacaacatttgaagcgagcgtgacattacaagatggcacaacgacgacagcgacaatcttgccatctggtgaatttacagttggtacaaaaccgttgacagccggtgaaatactatcagctaaagtaaccgcgattaacgggaacttcaagaaagacagtcagacagtcagtttgacggttgatgcaggcttaccaactaatccgcttgaaaattatgacgtggcaacaccgatgatgcaaccggcagttgagggcgataaggcaatcaaggggcaagttacattagtccaaccaattccaaatgggacgagttttaaagcaatgattacattaccagatggaacgacgaaagagacaaccatcaatagtagtggtcagttcgaattaacgaccgatgcattagtggcgggtcaaacctataccgctaaagtagtcgcaacaaatggtgcgaatatgaaagaaagtcaatctgcttcggtcactgtctctgaaaaagaagaaacagatccattagttgattacaacgtggcaacgccgacgattaagcaaggtgttgcgggtgaaacacaagttagtggacaagttcaactggatccagattggccagaaggcacaacctttgaagcggtaattgttttaccaaacggtcggacacgagctgtaagacttgattctggcgcagtagcaccggatggtcaatttacaattaatacagcagcattaacggctaatcaaaaagtcttggttaaaattgttgctaaaaacgggactttcacgaaggatagtgcaaacgctgaaatgatcgttaaagcagcgccaatcactgatccattggaaaactacgatgtggcaaccccaagcgttgacccggttaaagctggtgatacgaaagtgactggtaaagttgaattagtgacaccaatcccagaagggacaacctttgaagccgttgtaacattgccaaatggcgacaaacaaacagtcacaattgacgagaatggcaactttaatatcccaatcgacgcagttaaagaaggcgaccaattaacagtcgaagtaatcgcacataacggcgatcacgaaaaaggtagcgataaagttaatgtgaccgttgaagctggcaacccaggcgaaacgaacccactagaaaactacgacgttgcgaaaccaagtgttgacccagttaaagctggtgatacaaaggttactggtaaggttgaattagtaacaccaatcccagaagggacaacttttgaagctgttgtgacattgccaaatggcgacaaacaaacagtcacaattgacgagaatggtaactttaacgtgccaatcgacgcagttaaagaaggcgacaaattaacagtcgaagtgattgcgcataatggcgatcatgaaaagggtagcgataaggttaatgtgaccgttgaagctggcaacccaggcgaaacgaacccactagaaaactacgacgttgcaaaaccaagtgttgacccagttaaagctggcgatacgaaggttactggtaaggttgaattgactaaaccaattccagacgggacaacttttgaagccgttgtaacattgccaaatggcgacaaacaaacagtcacaattgacgagaatggcaactttaatatcccaatcgacgcagttaaagaaggcgaccaattaaccgttgaagtggttgcgcataatggcgatcatgaaaagggtagcgataaagtcaatgtgacggtcgaagctggtaatccaggtgaaacgaacccactagaaaactacgtcgttgcgaaaccaagtgttgacccagtcaaagctggtgatacgaaggtgacaggtaaggtcgaattagtaacgccaatcccagaagggacaacctttgaagccgttgtaacattgccaaacggtgataaacaaacagtcacaattgacgagaatggcaactttaacgtcccagttgacgcggtaaaagaaggcgacaaattaacagtcgaagtaatcgcacataacggcgatcacgaaaaagctagcgataaagtcagtgtgacagttgaagctggtaatccaggtgagacgaatccactagaaaactacgtcgttgcgaaaccaagtgttgacccagtcaaagctggcgatacgaaggttactggtaaagttgtactaacgaaaccaattcctaaagaaacaactttcgaagccgttgtgacattgccaagcggtaaacaagtgaaagtaactgttgatgaaaatggcaacttcacgttaccaattgatgccgctaaggcaggtgacaaattaacagtcgaaataatcgcacataacggcgatcacgaaaaagctagcgataaagtcaatgtgacggtcgaagctggtaatccaggtgaaacgaacccactagaaaactacgtcgttgcgaaaccaagtgttgacccagtcaaagctggcgatacgaaggttactggtaaagttatactaacgaaaccaattcctaaaggaacaactttcgaagccgttgtgacattgccaaatggtaaaaccgtgaaagtggcagttgattcaaacggcaacttcacattaccagttgacgcagttaaagaaggcgataaattaacagtcgaagtgattgcgcataatggcgatcacgaaaagggtagcgataaagttaatgtgaccgttgaagctggcaatccaggtgaaaccaatccactagaaaactacgtcgtggccaaaccaagtgttgatccggtcaaagctggtgatacgaaagtaacaggtaaggttgtattaacacaaccaatcccagaaggaacaactttcgaagccgttgtgacattgccaaatggtaaacaagtgaaagtaacagttgattcaaacggcaacttcacattaccagttggcgcagttaaaaaaggtgacaaattaatagtcgaagtgattgcacataacggcaatcatgaaaaaggtagcgataaagtcaatgtgacagttgaagctggtaatccaggtgaaaccaatccactagaaaactatgtggttgctaaaccaagtgttgatccggttaaagatggtgatacaaaggttactggtaaggtcgaattaaccaaaccaatcccagaaggaacgacttttgaagccgttgtgacattgccaagcggtaaacaagtgaaagtaactgttgatgaaaatggtaacttcacgttaccaattgatgccgctaaggcaggtgacaaattaacagtcgaaataatcgcacataacggcgatcacgaaaagggtagcgataaggttaatgtgaccgttgaagccggcaatccaggcgaaacgaatccactagaaaactacgtcgtggccaaaccaagtgttgatccagttaaagctggcgatacgcaagtgactggtaaagtcactatcaataagccattccctgaaggtacaacgtttgaagcaagcgtgacaatgcctgatggttccgttaaatacggtatggttgatatcaacggcaatttcatcgttaaaacagggcaattaaaagccggtcaaagattgatcgtcacgattattgcgcataatggtgactttgaaaaagatggtcaaccagttacagttcgagtagccgataataaccaggatggctctggcaacggcaatggcggaactggtaacaacactggtaacggtggcaacacgaatggtaattcaaacggtagtcataatccgggcaacaataatgccggtaatggtggccaaacgaataatggtggtaatgggcaactagggaattcaaacaacgtcaataatttgacgaataacggatcgaatagtggtcaaaataaccatcatatgttaaatgtgggtgttagtgacacaactggtagtcaaaatgctaacagtaaagctggcgatttaccacaaacagacgccaataagactggtgtctgggcagcggttggagcattcttaatcgcaatggtggcactatttaagagtttattaccaatcaaacgtgataaataaatggaaaaggtattaatattaggggcgcatggcaagattgcacaattgacacgagcacaattgctagctaaaacggatgcgcaattagtgttatttctaagaaaagcgaaccgactaacgatccaagatcaacaacgcgaacagttggttgaaggcgatgctagccagcaagctgatttagtccaagcaatgaaaggtgtcacagttgtctacgcaaatttagcgggcgctaatattgaagcgcaggctaaagccgttgtatctgctatgaaaacagcgggggttaaacgcttaatttggatctcaacactcggcatctatgacgaagttcccggggcatacggtcagtggaaccatcaaatgttagacgatggttatttgccaacatacgcagccgccgccaaagtaattgaaacgtcagggttagcctttacaattattcgcccagcttggttatctgataaggatgaaattgattatgaaatcacacaccgcacggatgctttcaagggtaccgaagtttccagaaaaagcgtcgctgcagaagttgtccgtttgattcaaaacccaactgaagcagttggtgattcattgggcttaaataaacccaatacggatggtgacaaaccagaatggtaccgctaaatgaacgaaccacaaaatcattatacaaatggcgtactgatgaccttagcggtgataggcacaaaatggaaaccattaattttatgtcatttagtggatggtccccagagaccggctgacttaaaaagagcggttcaaggaatctcatcaaaagtgctgacggatcagctacgagaactagagcgcgatgggattattacgcggaccatttttaatgaagtaccaccacatgttgagtatgctatttctgaatatggacaatcattggtgcccattctaggcgtgatggccaactggggtgaagcccgaatcgattttctaaagcaaagcggtgtagcagtcgatttgacttacacagatcatgaaaaatatgagctttaattaagactcaccaaaattatcgagtttaagtgatgcggtcagttgcaccaatagtgcatttcgattggttttgcgcgtgactgttacaatattttgattctggttaacatcttctaaatcaatgatttttatatgatattgctgtgccaaattaccgttattcataccggaatataaaaaggccaaacctttgccagcagaaacagcggtcaaaccttcgtcaaggttgttgacgtaataatccgcacgtaagttaaagccgtttataagtccctgattaacgacatagtcgacgataattggggattgtttgcgttccaataatataaacgtttccgattcgagttctgagaattttaacgagggttgttgtgccagatgatgttttttggggagcgcaatttgtagatgattggccataaaaaagtgcttttcaatgttttgatttcctgcgaagtaagatgctaagcaaaaaactaagtcataacggccgttatttaggccatcggctaaattcataggggtatcatcagttagcaaaattttaacatttgggtgagtcgctttaaatgtcgctaagcgatcctctaaaggcgacagattaaaattgggtaaaacgccaattttaataaccaccgaagattgtttaacatctttttggtcatcaaaaaggtgggttaaatgatccattttctcgagaacgtcgattgtttcggtgaaaaatttttcaccagcatcggagagttgaacactatacttatgtctaatcaggagcgtgacacctaactcagcctctaattcttgaatatgccgactgagtgtgggttgggaaatatataaattattagccgcccgcgtaaaacttttttcggtggcaacttcaacaaagtattgtaatgtagagatcttcaattatttgttaagaaggggaagttggatataggaagcatattgaccgccggtatggacggtatgtgtaccatgattatctggcgtacagccaggtgtacccggcataacggatcctaattcgtcttttgaactgataacaactctcaaagtctcgccagctttgtaggcaagaccaagtggactcagtacgatatctaacgcaacgatttcgttttcggtgagtttattgacttggtcaaaagtataagcgggaatttcaggagttgttagtttagtatcaaggtttcgcatagaagctcgtaatcggccccaggcacctttataccgtaaagccgaagcgccttcttgtgtgaaatcctgcaaagccgcgccatgattaggcacgacgaattcactgagtacgttgccacgacggtctagtttttgaatccaaacgaagacgtccagatcattgtaatccgtaacactcatgaagagttttgctttaggataaccaacaaattgtgtgtcttgatcgaaggtcatttggaatgatgttctgccagggaggccgccagctaaataactaactggtaaatcattttgttcgggtgttagttgtaaagttctagattgaccgtttagatagtatttagtagtaacgctttcggtaggcgggaaagttgttgctggaatgtcagtttggtttgtccctttaaaatcaataatgctatagcgtactttgggagttgttaaccaatcattgtcttttcccagtaaataaaagtcaaagaagcgccgtaattcttctgtgttttcttgatcgtaataatagggccattcctggcaatcatggattcgtaaccatttttcttttgagcccaatgttcgccatgaacgaaacgtgcccatcgtgtgaagtgtgtttgaataactagcgatgacaaaagcggggatggtgatttgacttggatccgccactttatcttgccaaattggtgcgtcagctagaggcgccgattgcatttctttagcgagatcttctcgttgtgcgtgcttggcactgacgtgattcacagcgagtcgttcaataaagttggtgtcaggaataccaccaatgaaggctaaatcacgataaccatcagacaagccttcagtgggattaatgcaagttagatgtggtggcatttcagcagcaatgtaccactgtgaaaaagcaaggtatgacgtcccggttagcgcggttttgccatttgaccatgattgagccgctaaccattcgattaaatcgtaaccatcttgggcttcttgtgagccaagcattgttgtattgccttcgctgtgagcaatccctcgcatatcaggattacagacggcataaccatgttgtacccaataagcaggatcaggcgcttcaaacttagtgaggcctgaattccaagcattgcccattcctaacatattgaataggttcttgtaacggggtgcagtaccagcacttttaccataaggactccaggcaattagtgtaggcactttttcttcagtaacgggcagataaatatcagcgtagatagtaacgccatcgcgcaatgtaacaggcgtgtcttttaacattttaatatcgcatgaaaggggtttgaagccttcagcaatttgttgtccttttttaagaatcacctcttttgtttcaaacgggctaaggacaccgtgttcgataccattatcgagatagttaaaagaggggctaaaaatcatttcttcagtaattttgactgtcatatgacaattcaaaataaagtcgtcgtaattaccggcgcatcaagtggaattggtaaagaaacagctacgttattagcggctaagggtgctaagttggtcttagctgcccgtcgtgaaagtatgttggcaccattggctgcatcgttgatcgccaaatacgatacggagattatctatcaaaaaacagatgtgacgcaattagcagatgtaaaagccttgatcgattctgcaatcactaaatttgggcgcatcgatgtgttgtttaacaatgccgggttaatgcctgtttcaatgttgcgtgacggtaaagtcgatgagtgggaagcaatgattgatattaatctgaagggtgccttatacggcattaaatacgcactaccaatcatggaacaacaaaagagtggtcatattatcacaactgattcggttgcgggccattttacaggtgaaggttcgtctgtttattcagccactaaatatgcgatgcgggctgtgatggaaggcttacgagttgaagaagttggtaaaggtatcaaatcaacactgatttcaccagggcatgcgcaaactgaattggccgctaaaattagtgatccaaaattaagagaagcggttctcaagagtgaatcagagactagcttgagtgccaatgatgtggctaacgccgtggtttatgcaattgatacaccagataacgtgggaatcaatgaagttatcttacgatcgattgatcaaagagattattagttattgttctttaagataggtaaacatggtaccgataatttctttagcattagaatctgtataaactgatagtttaaggtcaatttcgtccaagccttcaagtaatgcttgttgctttttaacgaccgcggctctatgattcagcagaagtgtcttgcgagcttcaattgattctggcccaatcatgcagtagtcaatatattgcttgatgtcagcaattttcatctgcgtattttttaagcaacagatggtatgaatgagagacatgtcggcatcggtaaaggctcggtagccgctactatctcttttgacaaaaggtaatagaccttgtttatcataatagcgaatcgtatagattgagaggccggttatttgagaaacttgtttaattgagtatgtcatatgaaaactgcattagtaacgggttcagataaaggattaggatttgaattggtcaagaatttaagccaaaacggttggcaagtgattttaggtgtccgcaatttagagcgtggcaaccaggcaattagtcagttaacatcattaggactaactaatctgagccttgtgcaactcgatttaatggacgaggttagtattaaagcagctgccgttgaaattgagcaaaaccatacacaactatcattactaattaacaatgcgggtattcccggcaaggaatacgtgggttatgaaacgccgcttgaggatctaaaagccacgatgcaagtcaacttctttggcacctatctactgattaaccaattaacgggattgctgcatcaaaatcaaggcacaatcgtcaatattacggtgccaactaatgccaatcatctttggaacccactcgcctataaaacaagtaagggcgctcaaaatgtgatgacgacttcgttggggatttcgtttgaacaacaagcgcaaaacatattaatttatgcgattcatccaggcattatgtcgacggacttaaataataacgtcacgggacctttcgtgcattctgccgaagtggttggcaaaaaaattattcaaacgattttaaataaaaaacaccggtcgggcgactttgttgaaatctatcatcagattccagataatgcgttagttcgcatgctagcaaagcggtttgggccacaggattagatgtcattgattggaattttaattgttatttatttttgctatagccagtttaaagcagaacggccaagacgtttccgctatcttttactaccactctacgcgttgttgatgtttgtcacgacttttaagctgaacgctacgaatctgttgttggctgctgttattatcttattgggaattgcgattggcacttttcaaggacggtttgcgcaactgtctttagaaaatgttcaaggccaaacgaaagttagcattagaggtggttggccgtttctattaggctggggattaatcttgggaattcaaattttgttaagtatttttttagcgcaccaccaaatggatacagcagagctctcccaagaagttttgcacagtgcgctagaagaattattaccatttagaagaatttacgcctttgactggtggattctatgggccttgtcgggaagtagtagtttagcctataccgggatgttggcttatcgatcaccagatttttggcaggcaatccggcgaagatcacatcggaaagcagataaaaattcaaaaaagcgagatgcctaattagatttggtaatcggggtcgataattaaaacgggtttgattgtttcacccttaattgatgcttcatttgcgagattgatatcttcgaagcgatagaatttttcagtcttatcaaatgggaacatcccttgacggtagaattcaattaaacgaggaatgtcgatttgtgggattgaatcgcccatattaacgccaacgactgatttatcgttaacgcataaatcgttccaagtatcgagatcgatgtggttaggggtaacagcgattgttgctgaaacaccaccttggcaaagggctttgattgagtcttccatgactggtgtaatcccagtggtatcgacacagaagttcacaccacggccgttagtgagcgcttgaatagctgcgacaacatcgtctgtttgacggctgttaatggtatcagtggcgccaagttctttagcgagtgctaagcgttcgtcgataatatcgactgcgatgacttttgtacagccagaaattttaccggccatcattgcggctaaaccaacggcccctgtaccgaagacggcgattgtatcaccaggttttggttttaaagtatttaaaacggtaccactaccagtgacgtagccacaaccaagaggtccgagctcacgtaaatctaaatcatcaggcactttaacggcatttctttcacgaacgacagtcgttgtggtgaatgatgattgatcaaacatatcagcaacatggtgttcgttttcagtaaagtgagaactaccgtctggacgtacaccagaaaggttattttcagcataatttaaacattgggttggtacccctttaagacagttttcacaaataccacaagcataaaatgacagaacgacatgatcgccaacttttaagctttggacgtttgagccaactttttcaacaatcccggaaccttcatgaccaagcacaattggataaccaataattgcatcgcctttacggagtgcttcatcagaatgacaaatgccactagcgaccatgtggacttgaacatcatctggatggagtggggctaattcaatattatctttaatgacaaatggtgcaccttgttgttcaacgactgctgctttaattttcatctaaagccatccgtgttgttcacggtcccaatctttttttaaagtgccgctgacatagggattaccggtaataaaataacggtaaggcagttgaccactggccgcttcagtattaacgccgatgcgaggcgccgttgtaatatgacgtgggtgttgccgatttgcaagatcaattgttaactgtgcagcggccacatttttaaaagtcagttgtttatcatgaattcctaaggcgcccattaatttgccggggccgttagtgaggttaacaccaggtttgttcggccgattgcgttgcatctgcgccaaaccatgagtgggttcgatggcccgaatcaaaacgccttgtggttgatccacagcttgcgtcacaatatcaaataagaagaaaccgcgtaattggtagatataaatcgtgccgggttcgtgataaaggggttcactaaacggcgtgcggcgaccgttataagcgtgtgccgcagtatcttgagcacccacgtaggcttcggtttcaacgattaaaccaccgagggtcccttggtggctcgtgtataacaggtgagtacccagtaaatcacgggcaatctcggttgtgggacgattggtaaaaaaagacattggtgctgattgtatgcttgtcatatgattaatattcaacaattaaaaatgcaattcgattctcaagttgttttagcaggacttgatttaactgttcaaccgggtgaaattatcggattggtcggtgctaatggggccggcaaatcaacgttaattaacctaatgttgggacgattaacaccgacgcaaggtcagattcgtattttgggcgaacaaccaaatgaaaaacaccactttaatcaagtcggcgctatgacccaaggggatgtgccgctagcacgtttaaaagtaatcgaagaactggcattagtgcgcagttattatcaaacaccactaccgattgaaacgttgttaacacttgcggacttaacggaacacgcccaaaaattagtgtcccagttgtcaggtggtcaattacgacgtttatcatttgccctcgctatggcgggcaatccacaacttctctttttagatgagccgacggttggcatggatgtcggtagtcggcagaaattttggcagcagattgattgtttgaaaaaacaagggaaaacgattattttaacgtcccattatttagaggaaattgagcacattgcgacccggattttaattcttaaggcgggccaatttcaatatgatggggactttgccacgttacaacgccaattcaaggatgcgcaagttagctttacgacgaccgaacctctagatagttttacacagtggtcggctgttaccagtgcaagtcaagatggcgcaaaagtgacattacaagttagtgatagcgatcaggtattagcacagttggcgccgttactaaacacaaaggtccacgatattcgaattcaagcgagttcgttagccgatatctatcgcgaaataatgggggaataaatgaagacagtgatgacacaaacaaaaatggattttaagcgggcctattttagaaatcctagatttgcctttttctctttattaatgccaattggtttttatctcttgtttacaaaagtgatgaatcaaggtctagcgagtgcaagtttcaatctacaatacatggttagcatgacgacgtatagtttaattctcagcaatgtttttacgttatcgacgctgctttataatgatatgagagagggtttgttagcgttgattaacctttcgccaaccagcaaagcgacctattacacggcaaagttgcttaatttaggcgttatcaacggcttaaccattatcgttatttttgtggtcgcagcacttagcaatcggctccaattagcatggacaacatggctattaacagcggggtggttgtggctagcaagtttgccactttgtttgctgggtattagcatttcgtttttaaatgatgataatcaaattcagttggcggcgaatttactcgcatttccgcttgcgattttaagtggtctttggtggccgctagcaatgatgcctaaacaggtgcaagtcattggccggcacttaccggtttatccaatcaatcaaatcgcgcagtcaatcgttttaaaaaagacgcttcacttcgcagattatggcgtaacgcttggttggactgtgatattagttgggcttgtcgtatacttaaatcatcatcaaaagggagcacgtcattaaatgtctttttttaaacgttacattgcaatgccccaacaatacggcctttttccgtatgtttggttactctttttacttttcccaatcgcctatgcgtttccgtttaaaacattgcggcaacaagtcattataggtttggtgcttatttttgtgattgcgtaccgcaatagttatgttgccactacgtatcgaccgttctggttgttgctccaaatggtggtgagtgcgattcttgcggtgattgttcaagcgctctatctcagtatttatacggcctgggtgtttggctcgattccgatgcgccgacgtagtttctggggttattacggggcctatatgctgtcaatcttggtgcccactctttttctttactattattatggtggtcagatggggcgtgatgattgggttggcttagccgtctatggcttgttctgtgtcttatccccatttgcggcaggttcgattcaacgttataatcgcaaaaaccggcagttaatccagactaatcagcgattgacggaaatcattaaacaaaatgagcgtcagcgaattgcccgtgatttgcatgataacttaggccaatcgttttcgatgattactttaaaagcggaatatgcgcgtaaattattggctaaaaaaccggatgcggtgcctgaacaactattggcgattgaacaagcgtcccgtcagaatttaaaaatggtgcgtgacattgtggctggcttacgccaaacgacaattgccgaagaattgattaatcaagaacgtaatctcagcgtagcgggcatcatcttattaacgaaggatgaaaatcaaattgaaggtttaccacaatcaaaccaacaagtattagcacaatgtttgcacgaagcagtgactaatattattcgttacagtcacgccacggagtgttacgtgacgtttgcgcaatcggcaacgacttttcagatgacgattcaagataacggccgaggcttgaaaaaggctgaccagtttaaaagtcatggaatggcagggatgcgtgaacgcttggaagtgattcagggtgaactgaccgttgatggtcgccacggaaccacgttaatgctgacaattccaatcgttacggaggcaaaaaatgattaaatgattaaactttatttagcagaagatcaacaacttttaaacacggcactagctggtattttagagctagaagatgacctaacaatgattgggaccgctacaaatggccaagtcgccttggaacagattgcaaccttacaaccggatgtcgctttattggatatcgagatgccggggttaacgggacttgaaatcgctcgacgattacatgaacaacagccacaggttaaggtcatcattttaacgacctttgctcagactagttattttaaacaggcgattagcgctgaagttgccggttatcttttaaaagacggccccagcgatgatttaattgttgcgattcactcggtgatggcgggcaaaacaatctacgccccagaattagtggtcggtctaaccaaccaaccgcaaaatccactttcacaacgagaaaccgatgttttgcaggcagtggccaatggtttgagcaataaagaagttgcgagtcaactcttcttatcggatgggaccgtccgtaattacatgtcgacgattctcagcaaattagccgccagtaatcggattgaggcgattcaaattgcgcgccataatggctggttataaatgagtttagaaaacctgcataaatgggcatttttttatttttcacccgcattttccccggaacaaaataccgttattaatcgtaatcaggctgggacctgtgaaatgattaccgtcggttttgatccaagcgctaaaacggatggctcggtgattgaattagtcctacaattgaaggcagaaggggttcagttcatcgaactttgtggtggttttgggccaacttggacgactaaaatcaatgaggccctgaactatgaaataccggtgggcgcggttatgtacggccctgaattccgccaaccattatttgaaatcttgcaataaatgttaaagaagcgacgaacattcataatcggattgggggctgcactattatgtagtctgttcttgatcctcaatgttgctaatgtgcaggccaaacaagttttacagttaggtgcacaggcgccgcttgatacgatcgatatctcgacttcaacgggttacggtcaaactggtaatattttcgaaagtttataccgactcggcaaaaaaggtaaaattgaagctggcttagcaaagagtagtcaagtttcagatgacggtttaacgtggacttttaaaattagaaaagcacaatttagtaatggggatccaattcatgcccaagattttgtttattcttggcaacggacgattaaaccaacgactaaatcgccttacacgaacctatttagtaatatcaaaaacgccccagcgattgcggatggcaaattagatccgaagcaattaggggtcaaggctttagataaacacacgctacaagtgactttaaccaaaccggttgcctacatgaagaccttgatggcttatccattgtttgcgccacaagatcaaaaggtgattgaaaagtacggtaagaaatacgcaacaaagtcaaaatacatggtttactcgggaccatttacgcttaaaggctggtccggaacgagtgaagaatggcagttcaagaaaaatccgcgctattgggatcataaaaaagtgaaattaagtgccgttaaatttacggtattggaaaataccagcacagcgttatatctctatcaagatgggcgtttggatttaacccaactcgataatcaacaagttgaaaattatagtagtaatcgcgatttcaagcgttatccttacgcgcaaacttacttcttaaaatataatttcaacagtgacaatcaacaggtcaagcacattttgaacaatcaagatgcgcgtttggcactatccttagcgattaatcggaagacaatgaacaaccgcctctatggctttaaaacaaatccggtcacgggctttgtcgcctctggtttagccaactcacccgttaaaaaggtcgatttcgccaaatcacaagcggtgccacatacggttgattacgaaccaaaactggccaaagaatattggcaaaaggcgctaaaagcaactgggatgaagaaggtgacactttcattaacagttgatggtgatgatccgaatacatcttatgtcagccagtatttaaaagggcagttggaagaaattttaccaggcttccagctcaacttaagaacggtgcctagccaagttgcaagcagtcgcgatcatgagggcgactacgacatcctattatccgcttggggggccgatttcaaagacccaatttcattcttagaaatcatgctaccaggggcggccaataataccggtggcttcaagaatgcggattaccaaaaaaacgttgatttagcgacaaatcaagatgctaatgatccaagtcaacggtgggctgatatggtcgaggcggcacaagtcttgaaccgcacacaaagcctgacaccgctataccaaaacgaaaccggctatctccaaaatccgaaggtcaaagggattatccataataccgcggggacgcagtggagttataagacagcctatattaaggggcaataaatggcaaagcaatatgaaacaacgatgattaatgaaggtggccgaaacggatttgtttacgacccagaaaaatcaacgaagtatgtgattaaagcgcctggtacagataaaactggtaagagtaccaacccggaacaactttttgctgccggctacagttcatgttttaacagtgccttggaactcgttttgagccaggatcagattaaagctgaaacgacggttaaagcaacggtttcactttataatgatggccccgcagatttctatatcggggttgaacttttcggtcatattgaaggcctctcaccagaagatacgaagcgctacctcgaaaaagcccacgaagtttgcccatattctaaagcaacacgtggtaatatcgacgttaaaattgatgtcatgtaagtgcagttttttagtaaattatttgaattaaagaaagaaattgatcaattttacaaggcggagttagatcgtttcgaaattaccgatacgcaattcttcttgttgaattatatcgatagtgtggaactagcaagtcccaccaagctttcaggcatctttaatatcagcacaccagcaatttcacgtctttctcgagaattagagaataaacgcttagttgaacggtttagagcgactggcacacaggctgactatcgcttagtctttatccgcttaacaccagccggacgtgataaattagccgctgtcaaccaagccttggaagaattaattaatacgactgaagaagatgcgatggtacataaattggatgccagtcgcgcactgattaatacaattcaactgggttagatggaagctattaacattgaagaaattgaagcgttagatgctgaagtcaaacggattattgcggacctacaagctgaaaaagataagaatcaagctttgatgactgaaaataatcaattacgtcaaaaagtcgaagagactaatcaatatcgacataaggcagaacaattagcccatgaagtgcaacatttaaaaacacaaaatcaaagtaatatttcagaacttaatagccaagacatctctgaaattatggttgccgctaaagttgccgctaaccaaatggttaaaaaggctgaaaaagaagcacgcgactatgaattaactaaaaaggcagcccttgaaacggttaaggctgaagcagacgtcttccaagccagcttgatgaaggttagaacccaaatcgaaaatgatttgactacctggatgacgcgcattgatgaaattgcgcaaacaccaaatgaacaaacgcaccaatagatgattaaactatatcgcggtgcgatccccagtgaacatgataatcagttggtgttcgaaaatgatccagaacaaattattaagacctataaaaaaatcattacgaaatacgctagtacattaccgagtcccaaaatctatgttcagtatttggaaatgcgttattactttgaagttgatattacagggcatgcacgagtgcctgttcgtcggattgtccgtttattaaaaagtgctttccctcaatttatttggacgcgggttgtcgaacacgctgacgatcggtatcgcttagaattcgtgccggtttcttggtcctacagtgattcggtcgatgcagaacaagtcttaaccgcagcgattgcagagatgggttacggtcaaaacgaattgtacgaaagtattaaacagcaaatggcgacgctttttttcgaactatttgatttcgaacaagcggtaatgcgccaaaaaccacaacaagaaattgtcgttccaaagaaggttagtaatttgaaaaaacaaccagatgaaattgtagaaaaatcatcaccagaaataactgatccagaggcggaactccaagctaaaattgaagatttactggctaagctctatgagaataaacaggctactgaaacgacagaagttgaaacggtcccgatagagcccaaagtggtgcctattagaaacacgcgccataagccacagcggggagagcgcacatcgtctagtcctaaagtgccagtggcgactgattcagccggaacactcttggctaaaattaaaaaaaaaatcgcacctatcacgaaacggtaattgaagaagcaattgattttaggtggcgtgagtcttgcggtcgtcatttcattagtattatcactcgctcaatttttcgaaattgcaagtgtggatgggcaatcaatgaagccgacttttcgcaataacgaaatggtcgttgtgatgaagaatccgacgcgtttaaaacgcggtgatgtgattgccttacaagtccctagtatggccgataagacgttcatcaaacggattatcggtttaccgggcgatacgatttatgccagcggtggagttttatacattaacgataaaccaattgagtgttttgacaagcaagggccaacgcccaagtttagcctcttaacgagtacgggacaaaatagcgtaccggataaaaagttatttgtcttaggtgacaatcgtcagaaatcaaccgacagtcgaacatttggttttgtggattataacgacatcattggtaaagtcggattatagatgagtataatgaaacgcaaaaaacaattgttattaatgagtttagcggctctgttagtgattggctttggttacggtatctatttaattgtaccgcaattgctagcgggtgatacgcaggttactgatttaacattgaaaagtcaggttaatgatcaaacgattcaattaacggtatctgatcagaaccagacagatacgaaagtggtcgtgccactgacagataaactcagttacacacccactaaacaagccaatgcgggggtgacttatgatgaagttaatcaccagattgtgattgactggttaactaatcaccctaaaatggtgaacttaacggttaaagcagcgcaagcggggacgtatgtctttaaagcacaaaccacgcgcaatgatacaccagttaataccaccccaattgcggcaacgattaaaccggttgaaaatacatcaacaagtagtgtcttaagtgacaatcaaacatcgttatctgaaaagatagcggtacccgggttacaagaaccagatacgacaagtagtcaaagtttgaatacggaacaagcaacacccctacaaaagcgcactactcgagatttacccacacacgcagatacagatatcgtaacaacagcggattttgataatcaaccttggataatatatacattaaataaagaatggaatatggatatatcaaatgggaaaataacatttgggatgctgaagaaagtaacaatgttagatttgtggtcaggtaaaaataatagtcaaactaataattatgcaacaggatatataccagccggaattaaatatttaactaatttaaaaatacttgggctgggaaagagtacaaaagctgaggtttcagaggatttaaatcctgaggttcatgtagcaaatggatatactagaccgggacatatctcagggagtattccaccagaaattggccaattaaaagaactagaaatattctcagtgggcgcagaaaatataacaggaacaataccagctgaaattaatcagttaacaaagttgaaacatatagatatcaatggttacaaaaaactaagttttaatttaaatagcatatctggattaacgaatctaacttcactatgtttatataatatgaaaaaaactgatggtgctttatctgatattataaatttagataagctaaagtacattgagttaagaaaagataatataaagggaaaaataccgtcagagatagctaatattaaatttgattatttgaatttaactctaaatcagttggaaggtactttaccggaatcgtttaataatttagattccaatgcatcaataaatcttagtgaaaacccagatatttacggggttatttcagaaaaagtagcaggtttaaatccaactcgaagtggggaaacaaacttaggctatactcagttaacgattaaagatccaaaaaaaatgaataattcagccataataccatttacctttatgaatggtcctagtagatctttactaagatcttttgctaaagaaaatcttgatggcagttatgcaaatacctcggtgactataactgattcttctaacacctcaaaaatacaggtatttgattcgtatggtgctaatattacagatccattaaatatcggtattggatcaggtagtatacaaaaaacttctgaaggtagatacatcaaactttctagtggacatacttttcaaatatcagattcaaaaggaaatttaatatatgatggaccagctgatcctaaccttagattaacacctaagtctaatgaaactaaatatgtaattttaatggaccacacagaacctaatccagacataggtattacggaattagatttaaatataaagtggataagaccgaagacaaccgaggacttaaaatcagaagatccgaatttaggtacagataatcatattaaatatgtaaaacaaaaacctttcgagatgattagttccgttcaaaacgatgatacctttacaatttcgatggataagaccgcattaacggtcaaacctgctgaaaaagataaggttgatattgataaaactagttttgaaatccaaaagccaaatacaacaatatgggaatcggtatcttctgcagatataagtgatattgaaaacggctatcaagtgaaactaaatggtttagcattaaaaccaaaagaaaaggtaaaaattagatattcagttactgctaaagaagcgttagacgacacaggagtattaagtagtgaaacaagtctaatgagtgggtataaattaccggtagctagtgctgatatgactattaaaaacggtcagctcctattcaagacagtcccaacaacaatgagctttgccgatagtaaaattgctaatttaacgacagaaatcaagcgtaagttacccgattggaaaatgcaaattgaagattctcgagttaacaagactgattggcatatcactgctaatctaatttctgaattgcaaaacagcaatggtgatagcctcggtgacagtgtggtcttcaagaagactgggcaacctaatcaagttattaataccacgagtgcggttgatgtttatgatagcaaggctgggacaactgattaccaagatgtccaatggggggctgatgctggacctactttaagtgtcgcacctgggctagccaaactgggtagttacactgggacgatgcaatggaccttggtcgatgcgccagcttaggtgtctaaaagtcgttttctaatgccattggtattaatgttatttttcattagtgttagtacggttgatgttcgtgcggccactgccacgagtcatgcgaacatcgggtttgatcggacgtatgtaccttcgaccaaaccacccgtgattgaagatggtcaacaggtggtgccgccagctgttaagccaccagtacagcggttgccacaaacggggaccacttcagtctggcagttacaagttttagggagtttattaatcacaggttactttgtagccagaaaaaaagggagattttatcatgaaggttaaatgaaggttaatcacattattttagcaagtagtttattattggctggtgttacaggcccagcaacaaccgcatttgcggctggcgcaccgattcaatcatcaactaaaggggatgttaattttacccaatcagcaacaccattgacaattgacaaggcttcagatattcattttggcacgcaaagtatttcagctaaagaagaaacttattcagccaaaatggacaatgatggtaagacggatgttgccaacgctgttcaagtcactgatatccggggcactaatatcggctggaaattacaggtcgcgcaaggcgcccaattaacaactaaagataccgccgctaaggaattaacgggtgcagaaattacattagacaacattaatctgaccactgatgcggataatcaagctggcgtaccaactggtggtgctaagattgcattagtcccaggcacaactgcgacaccaggtgctgcatttgacgttgctgtggcccaacaagatcaaggtatggggacttggaaagctaactttggggatgatcaatcaggtgcaacaagcattaatttgaaggttcctggggcaactgccaaagttaaagatagtgtatacgaaacatcattaatttggacattagcggacacaccagcttaaatgaaaaagacaatcaaatacacaacacttacaatggcaactttattagcagccggtgctttaattagcccaatcaatccagtacatgcggccgatggtggtacagcacactcaactggttcaattaaatatgtgacagataacagtacaactgatccaattgatccaacaaacccagatccagataaaccggtgacaccaactgatcctggacatgaaaacccaggtgctggtcctttaagtattgattacgtttcaaatatcaactttggcgaacaaaaaacaaccgggacagatgcgacttactatgccaatctagataagattagtgaatcagacggcacagccagtgaagtacctaacttcgtgcaggtaacggataaacgtgggagtaacgccggttggcatttatcagtcactgaagatacacaatttaaaaatggtaacgatacgttagatggtgccttaatcacaatgaaaaacggaacactttcaacacctaatgatggggaagcacctactgcaagcacagaaattaaattagttcccgggacagcttcagatgttgtggatgccgcaactgacaaagggactgggacatggttagatcgtttcggtaacgatgcaactgatggcaaacaaagcatctcaatgtttgtcccaggtaagactaaaaaagtacaaggtgaatacaagaccacattaacatggactttgacagattcaccagcataaatgcagaaaaaaggtttagggttactgttggccggcttagcattcttagtattatctgtgaagcccgccgcggcagccgaaatgcagttctcagtacaggctgaaattccgaagaatcaggttgataaaaccaagagttactttgatttgaagatgcaacccggtcaagaacaagatttagtggttaatatgcgtaatgatacggccaaaccggtcacggttaatgtattgcccaatacggcaactactaacgataatgggattgttgcctataatgaacaaaagaaaaatgacaaatcattaaaaataccatttaaagatatcgcgacaaccgataaagaagtcacggtgcccgctaaaagtagtcaacccattaaggtgaaagtcaagatgcctaaagcatcatttgacggaaccgtcttaggtggtatctacttcagcgaaaaggtggcagacaccaagactaagagtaatgattccagtcaaattgtgaaccgttacgcctatgtgattggcgttaagttgacggaaactgacaagcaagttaaaccggatttacatttaaaatcggtgaaaccaagtcaagtgaactatcggaatgtggtcaacgctaacattcaaaatgatcaagccgcgattttaactgatttgacgatttcggggaagatctatgaaaaagatggctcaaaagtcctttatcaagcgaagcgcgataaattacggatggcccctaattcaaacttcaactttgggattagtttgaatagcaagacttttaaaccaggacgctataccttcaagggcacggccaagagtggtcagcaacactggcgtttccaaaaagactttgaaattaagagtgctgaagctaacaagtacaataagaaagatgtgtcgatcgaacaaaatcatatgagcctctatcttattgcgggggctggcattgtcttgattttaatcattatcattgtgattttgatgcgcaagttaagagataacaaaaaagaagcatagatgaaaacattaaaatcaaaattagcgacaagcttgttgctttcagggatggtgttaccagcaattagtccagtgatgacgacttttgctgcaacaccaacaaccgctagtgcagcacaaccagtcgcaatggcaaaaccggttagtacgcggggctatgttgtcgaaaatacgacaacagttgatcttagcccagcattggatggcgatttaaagcaagcgccattaccagatggttttagtttccattttagtttgaatacagaaggtgccagttttagaggagcaatcttcgatccgaccagttcaacgatgaatgataatagtttattgttaggtgattctggttatattcaggcggggacgacgattcaatattttgtaaaaattggtacaacatggcatcttagacaggtgaaattcattaatactcgccaaaccgcgggtacgaaagatttcttttttgatacgactgaaattgaaaaaatcgctttaaatggtgattcaaattctattattcgtgatgttgcgccaggggttaatgtgaaggtttctgccactgctcgccatactacaattaatgttgatcaagttcagtatagcatcatcattcgaggcgaaaatgtccctaattatagttacgaagggattaacaagcatgacggactagtcacaagtcctgcttactcaaatacgaaggatacgactttcaccttttcatatctcaatgaacaagggaaaatgatgactggtgttttacatttcaaaaaagatgatatcaagccagcggcacaaccagtaacggttaattatgtcgatgctaatggacaaaaattggttgatagtgaaactttgacaggtacaattggcgcgagctataagaccgccgctaagactatcgctgggtatcacatcgtgcaaacaccaaacaatgccactgggatgttcactgataaggcgcaaacagtcacttatacgtatgctaaggacgctgtggcacctgaggttaaagctgtaaccgtcaattacgttgacgaaaagggtcaaaaattagcagctagtgaaacactgacgggtgaattaggctcagcttacaaaacaaccgctaaaactgttgcggggtaccatttaagtcaaacaccaagcaacgctaacggaacttttaccgataaggaccaaacagtgatttacacgtatgtcaaagatgcagtgttaccgacagctaaagctgtgacggttaagtacgtggatgctgacggtcaagaaattgctaaatcggatattttaactggtcagttgaatagcgcttatcaaaccaatgcgaaaatgattacgggttatcgattagtgaagaccccggctaatgccaagggtcaatatacaacgtcagcacaaaccgttgtttatgaatatcaaaaagagacaaccacgacggtgccaacaactaatgttaaaatgacggcgcgttatgtagacgaacaggggcatgaattagttaaatcaattactaagactggccaacaaggtgatcattataaagcgagtgccgcagctatcaaaggttatcaactaatcgcgatgcctaagaatgcagctggtattttggggaaagatgatatcacaattaagtttgtttaccgtaaagtagcaaccaatcatcaaacgccaaatcaaaatcagcaagccaaacctaataatgacaagcaccaagttacgaatcctaataatcattcaaaaggacaaatcacaactactaagccacaaccacaaccggttaagaaacaattaccaaaaactggggttgctaatccaatattgctttcagtgatgggaatggtattagcacttagtgcagttgtacttggtttctatcggaaactgagaaagagtcattaattattgtgtctttttatgtaaccaactcttcaaattaacgccaacaatgcacagtaccaagccaatgatgattgcactataaccagattgttgactggcgatgattgtcagtatcagcataatgaagaccgccagtagtagagcattctgaccgattgaggtggtggctttgtgatacgccactgaacaaagcgttgcaataccaatcgtgagggcggtaattaatagaattgcttgccagtgaggttcccataaactgagaagtgcaccgagtaaactataagtacccacgaggcctgctagcgaataataataagcatcaaggggattgaatttgtgcatatgatgtggattgggataattggtggtggctttgccgtgatgattattttgaatctagcttattcaaaagggctgaccgcaattgcccagagactaggtgtgccttatggctattaccaccatatgcatcatgagcggcatcactatgaagaacaatatatggccaatgattttgacgaggtggggttaatcttaggcgttttaacggtcttaggtggcgtatacttatgcttcagtttactggaagatcaggaaaaaaaacataagaaacgcgcaactaaacaacataataagcgacttaataaagtaaagaaacgtcactagatgacattactgacagcaacagggattacaaaaaaatttggcactaaaactgccgttaagcagattgatttaacggttcaaaccggccagctagtggctttcttaggccccaatggcgcgggtaaatcaaccacgattaatttattaaccggtacgatcgcaccgactgccgggacaattgagatggcaggtctcaagccggataatcgccaatatcaaaagcagattggtgttgttttccaaaaaagcgttttggataatcagttgacggtttggcaaaatctcaaaagtcgtgctgatatgtatcaaggcgtcactttaacacctgaaagtgaattgattaccgcttttggtttaacgtcgattcttaagcaaacttacgggacactatcgggcggtcagcgccggcgagttgatattgcccgggcgttgattcatcaacctaaactactttttttggatgaaccgtctactggcttggatattcagacgagaactgttatttggcagacgttaaaccaactacgtcagcaacaggggttaacgattattttgacgacgcattatttagaagaggcagctgaagctgattttgtctatgttatcgatcatggtcagattattgcggccgatacggttgagcaactgcaagcaacctatgcacaaagtcagttgatgattgaaaccgattatccggaagttgttttggcccaattagcaccagaatggcgtgtcttgcaaacaaatcatcaattacagattgcgctacccgatgatcagcaggcaatcgctttattaacaaaagtacagtcggtggttacccattttgaatttcgtcagggtaatatggatgatatttttatggcactaacaggaaaggagattcgctaaatgatggctttagttaaacggcacttagcgctttatttcggtaataaaagtggagtgttcttttcattattgggcgcgttaattgcgtttgtattgtacctcgtttttttgaagcataatatgctagccagttggtcacaattagcggctccacagaagttacttgatccctggttaatcggtgggacgttagctgtgacggcggtcaccacaactgtcaatggcttgaatcagatggttgtcgatcgcgaatcgggaacactggccgatttagcattaactgatatgtccttcatcggcattcagttcagctacttagtaagtgctgtgatcattggcatcttgatgcagttggtcatgtttgcagcaatggttggttattttagcctcacggatcaatttgtgttgtcgctagcagcaatcggacccgttatgggcataatgttattgagtagcattgtctggacgacgtttaacgtactaattttatcgtttgtcacgaatctggattctctagggaaaatcggcaccattttagggacgtccgccggcttttttgcaggggtttacttaccgattggagctgttccggtcgccgctcaaaatttaatgaaaatcacgccgtttccatataatgcggctatctatcgccaagtattgatggctgatcaactaaaaacgactttcaaacaggtacctcaattacgtcatcagtttgaacagacgttaggcatcggcattcagttgcagcatttaaccagttggcaagcaaatgccttaatcttagcgggctttagtgtcgtctttggcgcgctcacactggtgtttgccaagagcagtcgtcgcaaagcaatcaataaggtataattgaaggttaattttgaacaaaatgaagacttggcagatgatgatattcaagtgacggttcaagctgcccacctttcgccgacggtcatcgaattgattcaagcgctggaagcccgccagcaatcggttgatgtttatccgattacagttgatgagcgggtcgtgttagtgccaactgccgagattatcgcactagaggtctacggtaatgatgtgacgctctacacggttgaggcgacctatcaaattcggggtgttttgaagaagatactcagcaaattaagccaacaagatttcattcaagttgcaaaaggggccgcgattaatttgaaccatctccaatcgttagaggctgctttttctggtagtatgacggcctttttaacgaatcagttgaagatgagtgtgagtcgtaaatacttaccagagttgcgacaacaattagggatgtgaatgctgaaagaaagtttaaaaagtgcggggattgggttattgattggttcatttacttttttagtggtcatcatgagcctcaattcaacgattacaataacgcgtgctaatattctaagcaattgggtcatgagtgccttgattgggattatatcaatgatttttgatagcgaaaaaataccgttcgcatgggcgctctttagccattattgtggcgttttattactcgttggcttaactggcatttataacggcttgtggcccatttttatagcccatccagtgcgccatgtactgtttgtaacactgatttacgccctcgtttggctaggattgcaaattagtaactggattgatgtgcgccgaatgaatgaaaaactggctaaacgccgacaaatgaaaaaataattaaactctagcgtatttacgggcatcagaatagttaaaaaattcagctttggacgtgcagtcgccacgataaacaccattccagccggctctttgaccataagcacctaggtcgattaataattgttcttcagatttattgagatgaattttaccaaagccaacactataaatataatttgagaggcggttgactaacgcttcaggattcttggcagtttcaagtgtgagatagacctgactcaaaacatcggtaatatcgagaagtgcatttgatttatctggatgagccattaggctgttgtaaagtgtgtgaatattttctttgaccattgattgatttgtcatttgagcttattgttgaaacaaacccaggaataccaaaaaattctttctttggtaatatcaatgatcattatagcggccgcctatttgagccattcacaagcggctttaggatttctaatcgtttttggtgttgctagtttaggggagcatttcttactctattcatcgaatgtcgaaaacagttgggcagggaaagtagatttaatgattaaaattgtcggtctattctatgtcctatataaatttgttgggtagatgttatatacggatgtatgggtttcttttttacaaaatttcgttgcaattttattgatttttttattgtatagatatgttcaaagaaaaataacattaaaacgcatcgtaatggatgttctaataacggttattttttcaatattatatctgtttatttcagatgcatccttacttgtgatggtattaatccggttgggatggcactttcatcagcagaaagaaaataagattaaaacaacagatagtgccgatttaattctgattattgttattcagttattattagttgccatagggacgattattagtcagtttagcatgtcgattatcaaacatgattttagtgtcaaaattttgagtagcaatgctactgaaattacattatggggcatcttcattgccgttatactggatggtttatttttaattttattgaaaaataaccgtcccaagttacaacgcttaaatcaagaaattacagaattttcattggaaaatcaatacttcagatttacgttcggtctatttttagcgatacaagttgtattggtaattggaaatcttcaggggataacagcaacgatattattaaccattattatcatttttggtgtcctcatcgggatgacattttggcaagtgatgctttttttgaaggcttattcgattcgccaagaagccaacgaccaatttgtccggaatcaacaacttcaagattatctagtcaatatcgaacagcaatataccgaattacggcgatttaagcatgattatcaaaatattttattgtcgttggagagttttgccgaaaaaggcgatcagcaacagtttaaggcctattatcaagaattattagcgcaacggccaattcaaagtgaaattcaaggggcagttattgcgcaacttgattacttgaaaaatgatccaattcgaggattagtcattcaaaagtttttggcggccaaacaggctggtgtcaccttaaaatttgaaatgaccgagccaatcgaattaccaagcgctaatttattgacggttattcggattatcggtattttattagacaacgctattgaacaggctgttcaagaaacagataaattagtgagttgtgccttcttacaatctgaaggcttaatcgaaatcacgattgaaaatacggccagtcaagttaaggatatccaagcattttcagagttaggttattcaaccaaaggtgctggtcgggggactggtttggctaacgtacaagatttgattgccaaacaaaccaatttattcttagaaacacagattgaaaatagaaagttacgacagacattgatgattacggaggaaacttaattgtatcccgtttatttattagaggatgatttacagcaacaagcgatttatcagcaaattatcgcgaatacgattatgattaacgaatttgcaatgactttaacatgcgctgccagtgatactgagacattgttggcggcaattaaggaccagcaacgaggtttattctttttggatatggaaattgaggataaccgccaagccggtttagaagtggcgactaagattcggcagatgatgccgtttgcgcaaattgtcttcattacaacccacgaggaactgacattattaacgttagaacgaaaaatagcgcccttagattacattctcaaggatcagtcaatggctgaaatcaaaaggcaattgattgatgatctgttgttggctgagaagcaaaatgaagcagcagcgtatcaccgagaaaatttatttagttataaaatcggtcctcgctttttctcattaccattaaaggaagttgtttatttatatactgaaaaagaaaatccggggcatattaatttgttagccgttactagaaaggttacctttccaggaaatttaaatgcgctggaagcccaatatccaatgctctttcggtgtgataaaagttacttagttaacctatctaatattgccaattatgacagtaaaacgcgtagcttaagctttatcgatggtagtgaagcaaaggtttcgtttcgtaaatcacgagaattagtagctaaattaaaacaaatgatgtaaatgaagagattatgcatattagtttatcaagggctgtcatttctgattgataatttggttatctttaataagaaggaacggaattttgtgaagaagttaaacaatagaatcgatgaactatcgatgagctggcaagtagaacttgatagctcatttggaaatattagtgatattgaagtcaaagcaccgcaagccgtgttattaaaaaatggcttgcgatattgttttaatactggcagcttccctgaaaatgatatctatcaattgggagctttagaattacaagaaggtgatattgatgccgttatttcttttttgaagcatttagataggtagatgcgtttaaaaaagaatttctataaatcattagatctctatattggtatttgggccttaataactagttttacagtattcaatgaaacgatgtttagtgtttcttggtggttggatattgttggtgtcataatagggatttcattaatcgtatcaggcttatttttaggcgataaagcttaaatgttgacaattaatgatcaagaactattcgatttaatcgatgcagcttacaatgaagatttatcaaatcaaccacaaaaatatgaatacaaggcagccttattagcaggtgccaagcgattaatcgaaggtgcagattcacttagtgtctgtgtcgatatctacaatgcttatcatgcaaattacatcgtatcgataagcttaccgcgtgctaatcgcaatttatatggttacattcatcataaattagaaaaattagatcgaaaacgattacgcgatttgaatttaggttatggtttaattgcatcttcaataatgtttggcggtatgcattaaatgaaatggtattcaggtggttcagaacgtagtgaacaagcgattacaataattaaggcgttattaacggatttacaagatgcttcaaaagggcctgctttacaaactgttttaacgacttatcaagcagaacttgaaagtaaaaaagcaagcgtgcccttgatcttgagtcgcttaaatttggcaattgccaatgcgcttcaagaagacggtttgactttatcagctgcgcaagctgaacaggtcaaagcactaacggcactctctaacattcgatatggttactaattggctagtgatcaaggattgctgaacattttgcggttaattgaagtcgccttgagtgacccgcaagtagcggcagattaccaattagctgctcatttaaataggggcgcagcggctgttaaaagagggtatttggatagtcaatgccgcaatgactatcaacaagcaatcaattatttcctgatggttaacggctttaaggtttcaccggccctgatccaattaatgtcgttataattaatgattcgctaaaaatgcgacgactgagcgcgtactgagtgttgatagttctagtgcgccaagttggtagatttggttttgatcaaaatcgtgccgctcaaattggtgctgtaagccattttttagaattaaggcgtctggctttttggccttaatggcctggctgtctccaaaactttcatctagtgaaacgtgccaatccaattgtttggcggcaagcgcggtgtttaagtgcatgacaaattcctgctcgtggtgactgctaaagttgctcccaataattaagggaagggttgtataaactaaaatggcttctttcatatgtttgataaaacgtattttgatttctttaagcatatgagtttaacaggtgatggcaccagttggtatttattggcgttgaagacgccgttagaagcagcatcagtcattgaacggctccaagggcagttcgaccaaattcgtttatatggtgaaggttatagtattcgaagcagtttgggacaagcaaaggtgattgaactaattgaacaatctttaaatttaaaagttgagcaagacttccaattagtcagtctttcgcagtttaatgcgattggacgttaaatggaagaggtggccattatggcaacaaataatttagttttgaagacagctgacatttgtgatattcgtgatattgaagaggcgcgggcaacaatcaaaccttacatccgggaaacaccattaattcaatcgatgtttttaagccggaatgtcgctaagggcaatgtttatctgaaattagaaaacatgcaattaacaggctcgttcaaatttagaggtgccaataacaaaattaatcatttaactgaagaacaacgtcaacgtgggattgtaacagcatcagctggtaaccatgcacaaggtgtcgcattaaccgctaagttattgggaattgatgcaacagttgttatgccagaagaagccccaattgctaaacaagaagcaacggctggctacggtgctaacgttgtcttacatggtgcaacgtttaacgatgcacgtttatacatggaacaattagcagaagaaaaagggatgacaatcgttcatccttacgatgatcgtgaagtcatggctggccaaggcacaattggtcttgaaatcttagatgaaatttggaatgttgacacagtaatcatccctgttggtgggggcggcttaatttcaggtgtggcaacagctttgaaatccttcaatccgtcaattcacattatcggggttcaatctgaaaatgtgcatgggatggctgcttcaatcgatgctggcaaaattacaagtcaccatgatgacttcacattagcagatggtaccgatgttgctattccaggagacttaacttacccagttgttcaaaacctagtagacgaattcatcttagtcactgaagacgaaatcgcaatggcaatgaccgacttgatgcaacggactaagattgtcacagaaggtgctggtgcattaccaacagctgccttattaagtggcaagattgatcctaagtggctagaagataagaacattgttgcgatggtttcaggcggtaatgttgatttaacacgggtttcaggtattattgaacacctcttcaaaccagcagacacaagcaagggtgttgttggatagatggttactatgaatcgcgtctgttatttcatttttttagttttattaaccagtgtgatctatgttgaagaattattaggggttagcaatcattatctagcccagcatgaaatacggtttatcgtgtttgatttaatcatgtgggggcttttattgactttgttgcttgttatttatcgtcgtctgtcaaaagctaacgggccagaagtagcggtcccagtgattaagaagattgggattatactgctcatgctagcagcgagttacttgttaaactggtttgatcaacagtggaatccactagcattaccataaatgcaggcagcaccttatttaacaacaatcggtaacggcttaatcgcaccaacaattgaagaactattatttagaggactcttttttaatttctttttcctgaagaaaacaaggtttaatggtttcttgaagatcattgtatcagggctgatatttggcagcatgcatgaattagcaattaattataattggttgatttattgcgcgatgggctggattctaggtgccacttattactggacgaaggatttgaaatgttcaataattctgcatgccttgattaatttgctttagttaatttgctttagctaatcggttagcccgcatttggagcagttttgaagttgttgccaacgaaatcgtggtgaggataatgaagaaggtcattggtaataatggtgctggcatttgagcacctgaaaatttcaggataatcgtggttagcgtcgtgaaagtcgataggatattcaggattaataatgagagctcgtagtgaccatcttgtttagagagaatgtggcctgagtataaaacgccaacagcaagaataatatataaaaagtaaaagcccccaaataaaataatgaagccactaggcgattccttggccattttgagaatcgtttggtcagtaaaaaccgtgataattgtggtgagaatttggtaggcaatatagagggttacgaggtagattagtgttggaatattgcgtttcaatttttgtttgagcaagtgaaaattattgttgtcggttcatcccatggtgggttcgaaacagttcaagaaagtttactagattatccggatgcaacaatccaatggtacgaacagggcgattttctatcgttcttatcctgcgggatgcaactctatttagaaggaacagtcaagaatgttgacgatgttagctatgcaacgccagaaggcatgcgtgctaaaggtgtcgacgttcgtttacaacaagctattacagccattaacgctgaccaacatacggttcaggttaaggatttaaaaaataacacaactcgtgaagaaagttacgataagctcgtcttaagtgtcggggctgtgccatttgaacttcccgttgctggtcgcgatttagctaacgtttatgcaatgcgtggtcgtgattgggcgattaagctcaaggccaaaacggttgatccaactgtgaaaaacgttgttgtcattggttcaggctatatcggtatcgaagctgctgaagtctttgccaaagctggtaaaaacgtgacagttgttgacgtcttaccacgtctattgagtttatacctcgatcaagaatttacagatgaattaacaactgaaatgcaagctcataatatttatccagcagtcggtcaatctgttaaggaataccgcggtgctgacggtaaagttactaaggttgtgacggatcaagccgaatatgatgccgatttagttatcgaagctgctggtattcgtcccaatacagcttggttgaaagatgtgctcgatttagaccgtagtgggcggattaagattaatgaatatctacaaacgagtcaacctgatatctttgcggtgggggatgcaacggttgttaaatatgcacctactggcgaagaaatcccaatcgctttagcaacgaatgcccgccgtcaaggtcgctacgctgctaaaaacttggtcacagctgaccaaccagtgccagctgtttccggttcgtcagccttaagtgttttcgattatcactttgcttcaacggggattaaagaagggactgctgataagtcaggcgttaagacccaatccgtcgttgttacagaaacttatcgtcctcatttcgttccagctgacgaaaacccagaagttaaattcaaattaacattcgatcctgaaacgggccgaattttaggcgcacaaatcatgtctaaagcagacgtcacagctaacattaacgccatctcattagccatccaaggcaagatgacggttgacgatttagcttacgctgacttcttcttccaacctggtttcgaccggccttggaacatcatgaacgttgctgctcaaaaggcacaacgtttgatgcattagatgtcgatagcttatttaatcgttatcacactgctttatattgtgctttacattgggactcgtagacggggaaaccaggaattgattaatgtcctaataatatggcaagtcctgattatcgttaatattatttttgacacaattggacatgaacaaagtatcgatggcttatacaaggcggtttatccgatggcactgtcgttcttttgttacttggggaaagatatgtttaagaagaagtagatggtgtctaatttatggcgtgcttttaaaaccgcctttttctttttaagcacaatggtcattgcaaaaattatttttaagtggacagcttttcgtgagtactatacaagtggtagtacggaattaggaggaatgggcattagcattatttttctaggtgtttacctagggctattattattattgaccttgcttattttcgcttatctacaggtaaaacaattatttaaaaaatagttagagcattggtaaaataatggttgtccatagccaggacagcggcatgatgacaatcatcgccggtatcatatccgcggtcggaaacatttttagctggaccattctaaagccagttgcgagcatcaaaacaccaccagcggccttaaaatcaaaaatcattgaaggggttgtgagggggtagattaagtgtgctgcgaagaatagggcaatgaagatcacgaattgcggaatggcaattaatgaaacgacaaagcctaagtttgcggcgaaaatagcggccgtaaagaaatctagaatcgatttagaaattagaatcgtggcatcgccattcatcccttcagttaaagaaccataaatcccagtaccactggcacagaataaaacaatgacagtaacgagggttgcatcaaatgtttgccgatccaagccagttggtgcattgatgaagcgcgagatgaatttttgcatttgtgcggcaccccgattaatccagtcgcctaggtgaatcaataagccgaagccagtcccgataataatggcaaaaatcacggcagccatgtttttcatcggtgcaatggcataaatccccatggtcattgagcaaactccaaaggccatgttgagtccatctttaaagttggcggacatctttttaccacccaaagcaccaaaaataccgcctaataagacggatagggcgttaatcataattccaattggcatatggatactcgaaaattggcaacatttatcgacttagcgcaaacgtgtaattatagtcgaacagctgaaaacatcttttcaactcaggccacggtctcaaaatatattatggcgcttgaaaaagactggggggtcacgttatttacgcgtgaccacagaacagtaacgttgacgaaagcgggcgcggccattttaccgagtgttaaaactttaatttaagtgattaagggtattccaacgatttcgcgctaccaagcttttcagttaatttttcaatttaatcagcaacatccagaaatcaacctcaagttcagtgaggcagagacaaatcaattgatggcgtccttagacgatggccgggcggatatcgtgtttactcgtttatttgaaaaaccacaggctgaatatgcggttttaggcgaggagcgggattattttgtcgccttgatggcgcgtgataatccactcgcacagcagaccgcattgaccgttcaagatttagcccacgagccttttctactattggatggggcgacaaacgtcttagcgccggtgatgcagaccctcgagcaagccggtgtggcaccgcaaatcgtctatgaaggccggcgagttgatttaattttggagatgctgaatcaaaaaatgggcgtttcaattatgatgaaccattcttttgacctagcgggttacgaaaacgtggttgccgtcccgattcatcccaaacaatacagtcagttagcctttattaaacgtcaagcgaatcaatcagactcagtgcgcttattctggcaatttattcaagaaaattagatgagtgaacaaccttatgatttacgtaaagtattggctgaaatcaaagatttaccaggccaataccatgaaacggatgttgaaattgatcccaatgctgatttagcgggtgtctatcgttatattggtgctggcgggacagtcatgcggccaacaaccgaaggcccaacaatgatgtttaataatgttaaaggcttccctggaagtcgcgttttaattggcttgcaggcttcacgtcaacgggtcgcaacgattttacatcatgactacaaaacgctgggtcaaatgttaaacgaagcggtaaccaaaccagttgcccccgtcgaagtgacacgcgaacaagcaccagcacaagaagtcgttcatttagcgagcgatgctgattttgatatccgcaaattattagcagcaccaaccaatacggaagacgatgctggtccatacatcacaatgggtgtcgtgtatggtcatagcgttgatcatcaacaaagcgacgttacgattcaccgaatggttcttgaagataaagatacaattgggatgtatatcatgcccggtggtcgccatatcggtgcgttcttaaaagaatacgaagcaatcaacgaaccaatgccaatcaccattaacattggtttggacccagcgattaccattggggctacttttgaaccacctacaacaccacttggttataatgaactccaaattgccggcgctttaagaaatgaagccgttcaagtggttccaggtgtcgcagttgatgccttagggattgctcgtgctgaatggattatcgaagccgaaattttaccaaaccaatcaatgcaagaagatattaatacgaattctgggtatacgatgccagaattccctggttataacggttcagcaaatcctgccgtaaatgtgattaaagttaaagcggtcacccatcgtcaagataatccaattgttcaaacgacaattggtccttcagaagaacacgtttcaatggccggtattccaactgaagcatcaattttgagcttagtggagcgcgctattccaggtaaagtattgaacgtctataacgcccctgctggtggtgggaaattaatgactatcatgcaaattcataaggataacgaagctgatgaagggattcaaagacaagcagcattgctcgccttttctgccttcaaagaattgaagacggtcatcttagtggacgaagatgtcgacattttcgattggaacgacgtgatgtggaccatcaatacacggtttcaagccgatcgggacatcatggtcttagaaggtttacggaatcatccattagatccatcagaattaccagaatacgatccagctcggattcgtgtgcgtgggatgagttctaagttagtattagacgggactttcccatatgacatgcaaaagagtttcaagcgtgcgcaatttaaagaaatcgcagattggcaaaaatatttagattaaatgcgtaaaatagtcgtcggcatttcgggtgccagtgggacaatttatgggattcgtttgctagaggcattacatcaagtgccagatgttgaaacgcatctggtcatgagtcgctgggccaaagaaaatttagccatcgaaaaaactgggtacactgaaaaacaagtcgtggcgctagctgattttgtccatccagagcaaaatatgggcgcaacaattgccagcggcagtttcaaacacgatgggatggtgattgtacccactagcatgaaaactttagcttcgattgcaaccggtttgggcgaaaatttgattgccagagctgccgatgtcactttgaaagaacgacgaccattagttattgtgccccgtgaatctccttttaatcagattcaccttgaaaatatgttgaagttggcccaaatgggtgtggcgattgtaccaccgattccagctttttataatcaaccacaaacgatagatgatatcgtcaatcatacggtaatgaaattattggatcaactgcatatcgagaccaaccttggttcacgttgggaggggttagctaatgcacgtcaaaacgctcgctagatgcacgtcaaaacgctcgctagtaccgaacaaaccgtacaatttgcggtcactgaaacggattatacaatgcacttaaaattagagcgccaaacgtctgatttattaattcagattatcggtggcgacgtgccccattacggcgtcatcacgacggtcgataaaacgggtaaggcattgaccacagcactccctagccgcccaggacatgtccatcaagaaaaagtattaattgaccaggttttaaaaactgttaagccactgattacgaataatgcggtcttagtgtctgggatgcacgtcaatgagattacaccggcgcaaatgcgcgtggcaatgccaatggcacatgaactaggagtcgctttagccaaatggttaaaagcacatccagatcaaacccaagtggttacctatgctaaataattatccaatacccatcacataaaatgctaatttatcggcgtaatgcggttttgtgtgttggttttgggcttgttcaactgctttgagattatcggtgatcacgccatccgcaccaaaatacatcatccgttggactgcctgttgatcattgggtgtccaaacaaagacggctttcttttcttgatgcgccgcttgaatgaagtgccggttgaccgtcgtcatttcaaccgcgtagaaatcggcgtgtgaaatgggtggcccgatgaaattaaagggcaggatataaccggtttgaatttgcggtgctgcttttttgacatcttccaccacttgccagttcaaggactgcaccatgtgatcgtgagtttcaatgttagttttgtatttggctaggaatttttgcactaagcccggattatcgatagttggcgtcttgatttcaatcaagagtttttgatggcgttggttggcgagtgcgagatagtcatcaaaagacgcgattggtgcggtgcgcttatgttcgcgcacggtcatattggtgagttgcgccagtgtttttgattggggtgtgcctgaatgaccagttaatggggccagctgaaagtcatgaaagacaacgaattgatgatctttggtcagttggacatccatttccacgtagtcgggttttaagtggtgcgtttggttgagtgcagtgagtgaattttgaacgccatttttttgagagacaccgcggtgtgagatgctgatggggtgttgaattgagacagcgcgaaggtaatcccaattgtaaaagccggcacccattaaagtaaccgcagccactagcaataataagccgctattgagggggacactcagtttgagactagaatagttgattgcgggccgattaaattgtgaatcggatagtagataatcaaccagtacgaagaagatggcgacagttgagaggaccaggttaatgaggaccaccacttgtaaaagtgtcatgagtagaactgcactttggaaaccgacgctggtgtgggtttcaatgaacgcctgaagctgaatcaataagaagaaactaacagctgtaaaaccaacgaggcccccaacgatgagtaacaaccggccaactagggttactaattggtgatgcgtaaagcgccagctcgtccgtagcgctttttttaacgacatttgttgaagaatgatatttgggagggtgaagatgaggcgcaaaccaatatataacaagctcagataaatgaggagccccaaaacagcaatcagccgtcgattggtgatgatgtaatctaaaataaaggcgggcaatttaaattttgtcaataaatcggagtggtagcccaaaccgcccaatgggataattaggatgtaataatataggaagaaaaaaatggtgccgatgcgcagatgcgtaatttgggcgaccgtcatcttaagtaatgcttgcagggccagtggtcgtttaatctgaataaaatacacacttaatagtagaaatgtgaattcgaagaaggccagtaataaaatcagtagtgcaattcccacgagcgctagaagcgcaaaggggtgctggtgaataagtacgggtagattgctcaacgctaaaaactgaatctggtaatgtactaaaatgaagtagctggctttacttaaaagtggcaggcaaattaaaagtaaaaagccatgcattaataaaacactgcggaaataagcttggctttgttttaaaaacgtaaaggtatttaaaaataactttttaaaatattgcatttaatcatttaatgaatagcgtagtttcatatggttagcgccggtggttaccatttttccgaggagttggttgagattcatgaagtaaatatcagcgagcgcttggttagcgacagtgagttgcgcggtgctattttccggattagctaaaattgcggcgtccgttttgagttgaatcttgcgacaatcaattaatgcttgggcttcaaaagcatcgcggagtccttgataacgattgaagtcagtatctccgagtagggctgttagacgatttaaccagtaaatgttgttaggatcaaagccggtttgtgtctcacgataaatggccggcgtcgtatttgtgttggcataaaatggcactaaaccgttaaaggtgttggggccaaatgccagccaatgaatcccggcaatcgcttcggggacatcgttgcgaatttgcagaatatgcgtttcttcatttcgatttaaaccgattgtccggtagcgttgacggtcatcttttgaacctgtgccataaggatcaaaaggcgtgttctcgaaatgagaactgagggcccatttaacggcttcaatcgttagttttttagtgggggccatcatgaagggcagttcttgatcttcatagtcaccctcatcaagaccaccaaatgcttttaaaatggcataagcgcggggattattataatgagaatccttgatggttgctgtaccaaagatgtggcggaggtttacttgatcttcatcaggattgagatggtattgcgcaattagacttggtagatcttctgagaatagcgtatttggtgaggcaaaatcgaatccagcaatgttgagacgattaggcgcaacgacaaaggcgttatctgggatacgaattgctgcccagtgatgcccgccgattgtttctaaataccaaacttcatcgtgatcggaaaaagcgatgccgttggtttcgtaagtgccataggtttcaaggagttgacctaaacgtaacacggcttggcgagctgattggctatagggcagaacgagcgttacgaaatccgcttcaccaatcccgtcatcagttagcggatcaattgctaagatatggggattgttggtaattgtttcgcatgcagtcatcgcgacgttggcgctattaatgccggcaccagcccaaataccatattgatcatcggcatcgggtgtcgaagtgtaacgtaacggacttgttggtagtttgattttgagcccattaatggctgaggtgtaatcaacgggttgatcggctggttgaataacgcggaatttttgcggattaggcttgttgtagccatcctcatttctagcgataagggttgagccatcaagcgaggcctttttccctactaaaatggttgtacaagaactgattcgtttattcaaatggcgaagtacaaaaaggggccaattatgacgcaatgggaatctgatttttcaaaagcgcgtgctaaacgtaagaagacactaatcatccagggggtggttttagtgttgattgtcgttggtggattaacttggtttatcagaaataacaacgctagccaaagcgttgcccaaaaagggtcaacgcaatcgggcgttttttaccaaccctcttctgaacggacgaaagcggccagtgatgaagttgtgattaatgaaaaagattttaaagcttcggccagcagtgctgccgcagaagccgataatcaagatggttgggatggtgtctatccagataaatacgttaaaggagcactgacaaccgattatatgaatcttatcgcgatgaacaatagtgggttgcgctggttgcaggggaatggctaccgtttattgacggaaagtgaattcttcaaagaaaccggccaagcagcacaaaacaaacaaaaaactgacatgaaaaaagttgtcgtcagagatccgggtacaagcttacccgctttaaatgatgcgtatggccatccgcgctactcatatttctgggcaacaaaagcccaaaaagccattctgggccaagttaaagttaataaccaatacctcttctttgaagtaggaaatagtttctttgataaatagctaaaaatctaagaaattaaccagtttttgaacagcttctttaccttgtttttcggtaacgtgagtatatatatttaaggttgtttgagcatcctcgtggcccagtcgttcttgaacctctttgatagatgccccagcactgaatagagcgctagcatggctatgcctaaagccgtgaacggtgatactaggtaaattagcgccactctcgttagcatcgcttataagcgctcttagccacttgctaggggtgttgagtgatttaaaagtattctttgaggttgcaaaaattagttgattgcttttattgatgttgaagcctaacattagataaatacggcgttgctctaaatgccacttttttaaatagagtagggtactttcatcaagtgagatggtgcgagtacccttttttgttttggtcggttgaaccaataagcgccccttatcaccatgagttaacgtcttattaatatttaaggtggcttttttaatatttaaatcatcccaagtgagtgacagacactcaccgcgtctaatgcctgtaaaagccagtacccgaaataatgtatatttctctaaatcgtttaccggatcaatacagttgaagaatgttttcagttggtctttatcccaaaagtttataacatcttctttatctagcttctttggcattgtaacgcgcgtacagggattatctttaatatagccctgtaagatagcatatttaaaaatcgcgttggtatagttaaaccaaggcttaaagctgtattccgtttgtttaaaccacttatttaatgccgtttgaatctgactagtggtgatcgtcctaatacgatatttaccaaaagcggggatgatatgattttgaaacacttttttctgtttatacatggtactttcacgaacagtattgatataaccagcccaccactgcttgtatacatcttcaaacgttaagttaatgggttgctggtctaattgtccgctatcggcttgtagctctaatttggataatactaagcgcgcttctcttaatgtgtcaaagccacggcgtgttgtatatcgtttcttgccggtttgttcgttgatacctaaataaacttgaaacttgtagaatgttttaccatctttttgatacttgctgattgaagccatctaatgtgattgttcgtctgccatgattcgtttaatttgtttatcaaagtcggagttgattttttgcgttttattgaactgatcgtattcaagggatgctttggctttagcattagttatcgaaacagagccgttattaggcagtaccttatattcttgaaattctaagaaacgatcaatgctattggcaaattcttgcatggtaaaggtgttgcgtcgttctatcaagccttcaatataatcaaagtaactggaaacggttcgttcaagttgcttgatttcttgctggtctaagtaattcttggctacttgggtatctgatttcaatattctaccatctggagagtgtttccacgttgttaaccccatgttaggttgattgtgattagcatggctactaatgatttcagcaccagtttggccagtgattgcataatgaaatttattttgaacggtagcatagaattttctagtaaccggactgtttttatcatagtcggtactaatttcttggaatatatcggtgattttaaaccatatacgccgttcacttgcacgaatggaacgaacgcgttcgagtaattcattgaagtaatctttatctagcaagttagaaccttgttttaagcgagcatcatcaagtacaaaaccttttatcatatattctttaagtgtttgagtagcccactggcggaagtgcgtagcttgaacggaattgacacgataaccaactgatatgatggcatcaaggttatagaagttggtttcttttgattgtgtttttccatctatagcaccatgttgagtggttgttacactttttgtaataaccacttctttatctagctcgccagagtcgaatatatcttttaggtgacggctaaccgttgcaatactaacaccgaataattcagccatagccttttgagtagtccataacgtttcattactgataatcacgtcaatactgatattgctattatcggttttatagagtaagaatttagtttcgttattggtcatttaataaaattttatatgagtaattattttactatcatttaaaccaatatttaggggcttttctagatgattggctggaccgtcaaaaaatggtttatatgggatatcgtctataaaatttttccgagtcacttcatgggacgtgtatattccggaaagttcagagccgaatactttatcaataaaaaagatattatctagcgaaaatatatcttcattaaataatgtaagttcatctgatgtaatctcataacggggatcaaaaattctttcaatacacttatcaaaaatgatacctgcaatcgattgttgtttttcatttgaaatactactaaaaatatcttttgcttcataaataacgtcggatttatcagtaaaactgatatcggaatagtaatcaatagtcttttttggtaagaggtggtcatcaactacatcgatagcgttatataagtaatctaatgttaatttataatagctgctgttaatcttttctaaatataaaatatgaatttctttagttgaagaatttttaaatttaaattcagtttcggaaataaaagaaaaattagataattgtttaaaattaaaaattatttgtgctgaatcagaaacatctaacattaaatctgataagtctatttttaaataatcgagaagagattctatagttgctaattgaaccatttttgattcattatttgctattgaggttaaagaagcccgattaataccagtttcggttgataatttgtttatagatatgtctttatcatccatgatttcttttagattaaaaataatcatatgcggactaaagaaataccacgctatatgactcttgttcagactaaagaatatttaaatatcggtagttacaatactttgtataagttgatcgataaaggcttgaaagtttctgttattggtggagtaaagcggatagatcgacaagaagccgatagatttatgcaatctatgattaaggagggctaaatgccactagaagtgacgttaacccagcaggcagatacggagcttagaaagcaagtttacagcattataacggaagctatcgagaatgcgcgccgtgatagtgatttagataagccgtttctaaagaagggggctactgctaaatggttggaggttgaccctaagacaattactaagatggttgccgaggggttaccgtgccactatacggcaggtgtccaattatttaataagcgagaagtagaacaatttatcttagatcataaattataaatgcagaaaggcggtaaatgtatggcgattttaccaacgtggttagacgcgcttatatggatgcttgcaggtgctggcatttatggcattactagtaatttaaaaaaatactttgattttgaatagatgcaattaaaccaacaaaaagaacaattagaattaatcgcaagcaagctaacagtggttagtgacagattaggcttaatcggtaactatttagaaaatattagttatgagtataaacgtggggacgcttgggcggtagatttttcgttatttaatcgggatggactacaaaacttaatgagttcgcttgatgatattcaagagcaagtacaaggacattcaaacagtctagtagatttgggggatgaactcgccaatgttaaataaatgttaaataaaaaatatgactactgccaatacttagcaagccagcattctaaagagaccttacaaattgatttagataaagttacgcaatgccttaatagtaaaaatagatcatctttctgtaaagaagatagtttaccaagattagctatgtacttgaagggggcgctcgaacttgctaaatgattgctaaatgaagcgctcaattatgctaagcacggattacaggtctttccgttaacgcctaacagcaaaataccgctaaaaggtactcaaggcagtaaggaagctaccagcacccctgaacaagtaaagacgtggtggactaataaccctgattgtaatattggcgtggccacccgtggttttattgtattggatgttgatgttaatcatgcagatgatgcagacggctaccatagtttggaagtgcttgaggaggcctataataagctacctgaaacgctaacggttaaaaccgccagtggtggcaggcatttatattttaagctaccagagggcctagaattgcctcagaaaattgcgttcttgaacggtgttgatattaaggcaaaccctaataattatgtattgctaccaccgagccaagtggatggggatgcgtacacgttcgagaaaaaacagccaatggcagacatgcccgagtggctaacaggctttattttaaaacgaaacaaaataaaaaagacatcccgagtgttcagtgctaacaagcgatatagaagccgtgtgaccgagttaatagaaatattggcacttgggtttgaaactggccgtaggaatgatacagctgcaaaaataacgggtcaattactggtgtatggcgtagatattagacttgcttggcagctggttcaatacgctaatggcaattctagcgagccattactacaaaatgaactagaaagaacgttcgagagtatcgcaagaagggagctgggggcaacgtgcaattaggtgcaattagatcagttagtagcgttacaagagcaagaagtcaccaagccgactacaatggctggtttaaaagttaaattagagcaactaggcgagcaatggcgcgttgatcgtacaaaagttaacgaaaaaacaggtgaagtgaaagcgcctagagttacccctagagctgtggcggacatcctagaaaaagagtgccactttaccaatataggtgatgcaaataaacagcaacttttcatatatgacatggcagaaggtttatatacaaaggataagcgtttaattaatcggttgattttgtccgtggaaagaaatttgaatatgcgccaatgccgtgacgtttatttctatttagaaacggactccaaaaggtctaacctaagtgatcgtaaagaattaatcattgttaataatggtgtgtttaataaaaacaccaataagcttgaaccttttacgcctgatcacgtctttatttcaaagattagtacaaattataaccccgatgccaaagagcctaccatacacggctggcgctttagtaagtgggtcaccgagctttcagacggtcaacgagataaggaaacgttaatatggcagatgattgcaagcgcggtaaacgctaattacagccctgaaactgcttttttcttaattgatgacgggcgtggccatactggtaaagggacattacaacaaattctaataaatttagttggtgaacaaaattgtgccagcttaaagctaaaagaatttgatgaacgatttaaattagcaaccatctttggcaaagccctagtgattggtgatgataacgaccctaatagctatgtagattcagtagcgaacttcaaaagtgtaactactggggatgtggtcagcgttgaaagtaagggtgttgacgctttaagtattaggatgacaccaaccattattcaatcaatgaatggcgctcctaagtttaaggacattacagggggctttaagaggcgtttacgggccattaaaatgttacaccaatacgacacaggcaacgtgaaccgcgatattaaggataaatatatctatgataaacgagtgcttgaatacatcctattcaaggctttacaaattgatttggatacaattatcgaaacaaacgagagcaatcaaaccatctatgaaattgctttggataatgatagcattttagattttttcgaaagcgaaatagttgaattgagtagcacccgtttaccaatcacttatctattcaacctatttcggtgctggtgtgacattaataatagcccaacaaaaataaaacaacgaacgtttaccacccgcctgataccaatcatggaaaaagctggctggcagtacaataaaaaagatttaaaaccgttagaaggctttcacagtatcgatttggataaattgaagcgtatggataaagatggcagatacatggttactatcaacgagcatgacagacaaggcttatttttaaaggagtaggtgaaaaataattatatcgataaacgcaagtctttgattaattggatcaaggatagacaatccctattagaacgggacttcccagtggtgggacatgaatttgaagaaactaacacgcctaaattattcaatgaattatcagcagatgaacaagcagtactcgttaattgggtgctaacaacgctaaaaccgattaaaactttcagtggcaatcggtcatcatacgagattaaacatatttttgaacgtacaccacttggcttttatgtattaaatggtgcaatgaaaggcgcgatgttaatagctggttatcagattaagaacgaaaaagaaataaattggacgtttaatatatccgaacgtagcatttcgcgggcctatcaacttggataaatgattaattttactaacaaacgattgcaattagtttatagtgcgatccctgaaggaattgaaagaccagtaactgccaaagaaattaaactaaagacaggtattccgacgagagatgtttacagttgcatcaatttactggtgactaagtatgccgtgcctatcggaggacttagacaagaaggcaagcacggctatttcattgccaccagtaaagatgaactggcagaggctatcacgccactagagagtcgtacaaggcatatgaacgaaagactgacagcattaaagcagattgatatttagatggtcaaaattattattacggatcaacagcaaagcaaagaatatcagttaccaagttatggaagcctaaccgtcacaactcaaaatggtaaagtggtgttcattgaacgaaccgacaagactaaactagtttaagtgagtaaactgtttgattttgatattgacgaggataagagtagacagcaagcagatgagttattaacgcaatattggcgtttaaagcacgttgtaataagtaccagcagtttaagaagtccttcttacagtcatacaccaaagtcttttagcagtgggaacgcaaccgagaaacgggcggttaaaacactcgaggcacggcagaccctagaatacatagacgtggctttaagtaagttaacggtaattaacagggaattgctaaagatgcagtatttaagtgctggtaaattaaccatggcttatatctgcggtgaactaggtataacagcatcatcattcaagaagcataagaagcaggctttgctagagtttgccgagtcctaccctagtgaaggcttattaatattcaaggagcattgaatgatcattgaccgaataaaccaacaagcaagtatcaaaaacgccagaaagctgttaaagagctatggcacgattagacggctagccacggtaaatactagtcatcccttacatgagcaggataagcgtgatttaaagtgtattcaagcgattgtaggagaaatggaagacacgcaagcatccattattaatatgtgttacttagacggtagtcataaaacaaggcaatatatagcggatacgatggggtatagcaggtctagttataatcggtttaagaatagggcgttattagcttttgccgaaagttataataatcaagagttgcttgtttataagtagttagtgatacacgaaccacttagagacactaaaaccagaaaatattattattgatagaatcgatacaattagcgaagcaactctaaatttacttgctttatagcaaacagtaacgttatgatctcgcttgctcttcaacgttacttctaaagtcccccgctttgttcggtttacagataagggctttccgttatctttaacaaccacacccttataatcaacgactgggatatctactatggttttcgtaccattcgttttgtaattaaaagccagttgatccttttgtgccgttaatttaattttattagtatattttccatgattaattgcaaactgtttctttgaaattgtatctcccaattttggtgtattaaccggtctgtaatcgttcacaggtgaatctctaaaacgtgttatatcaaatttcacatctggggctccctgtggatttgcacgatccgttacttgctttgtaatcatagtaaacatactcataaccgccacaattagtacaagaatggctgcaatattatacttgccaaattcctttgcttcaagtgcattggataatgcgaaagtacctgcgaatattaagtatacggtcgtatatgatgttaatctaaatggaaattgaataatgtccagcggtgtaccattcagtaatgcccacggaaatgaagccgtagttaccattagtatgcctgcgcccattagtagcgcagatttcacctgcactcctccatcacgtaatttggacatattcccaattgcgattacacccatgataatcacaagtaatccagccgtgtaatatgtcggttggttattggcactatttgttaaatagtctgtaacactaggaacatgtgcggataagtcaattctatcaactgtttccaattttatatgcagcatttgttcgccgatagtaatgatttgatacatagagaataagattgtcaatcctactgcttttaatataccgataataaagcctttttttacactaaaccaaccgataaacattctagcaaccatgactccacaaattaatacagctgtcagtaaatgcgaataaataatcccagtcatcccaatggctaaccaataccatttcgaataatcctttttttgaagcataatttcaagtgtcatcagtacaaatggaataaaactgagtgccatatattcgccgatatcaaatcgccaatatccatccatgattctatagaaagcaaaactatataaaagagcaaaaagatacgcttgtaccttatttttcgttagatatttactagatttataagttagagatagcgttataaacgttgaaattgcataaaataatccaaaagcaattacccagcttttagtgattatcttaaaaatgacaaccggaagagttgtagctacgtatggataaaatatattgaacgcagtccctctctcaaaaaaagattgataatctaaccccgtaattaaatggtgactcgtaatactattatatagactatatgtacgggataagtgaaataaataatcatcacccgatgttataacctgtgtagttttaaaaagtggtgctgtaaaaatcattgctagaataataaacgtgaaataaacccaaaattctttttttaaaaaagctctaattttagtgatataaaacactccttgactgataatccgcacatgtcgatttattcagcactcaaatcaatttcaaatgatcgtaacgtttccatttatcgaatcgaacgcgatctgaattttgttccaggcaagattagtaagtgggacgagtcaacgccaggcgctgacgcgcttcaggaagtggccgaatatctaggaaccacttcagcatttctcttgtcgcaagcacgaaaagaaggagtcaccgaattgatgactccttaaatgcgcgatgagttatctgcaatagaagcggttgcgcctgattttgtcggtgtcgttaagaaacgttaccaagtcctacaacatattgattggcttgcaccagttgggcgacgcacacttgctgagcagctcaaattgagtgaaagagtcattcggacggagacggattttttaaaggcacaaggtttgcttaattcgtcaaaatcaggtatggttttaactgtcaaaggacaagaagttcttgaccagttaagacaagtaatggaccagttcttaggattacggcagactgaacgagagttgagtcgctaccttggaattgagcattgcttaattgtttctggcaatagtgatgaacaaccaaaagtcctcaccgaaatgggcaaattagtcaatagtacgttacagttgttactaccacaaggacaaagtgttgtggcggtaatgggtggcacgacgatggctaaggcagctcatgaactgtcaactgatctttctaaaaagcgcaatttaatctttgtgccggctagaggtgggattggtgagagtgttgatattcaggcgaatgcggtttgtgccgagatggccaaccaaactggtggtaagcaccgggcattatatgtccctgaacaggtgagtgagaaaacgtatgccccattattagaagagccaagtgttcaagaagtattaaaactgattgaacgcagtcgtggcgtattgcacagtattggtgaagccattacgatggcagaacgtcgtgacatgccggttgaaaccatcaagatgctgaaagaaaagcatgcggtgggtgaagcctttggttacttctttaacgctcaaggcgaagtggtgtacaagattccgcgaattggattacagattcgtgacttattgaatattccgtgtgtactcgcggttgcaggtgggacttctaaggcccaagcaattgaagcgtacatgcacctcgcacctcaacagacgtggttaatcacggatgagggtgccgcaaactcgattttacaaggggcaaccctttaaatgactacaaaagtagggattaatggtttcggacgtattggtcgtttagctttacgtcgtatttacgcaacaagcagtgacgttttggaagttgttgctatcaatgatttaacatcaccagacatgttagcacacttattaaagtatgatacagctcatggtcaattcgatcacgaagtatcagctacagaaaacagcatcgttatcgatggcaagaacattccagtttatgctgaatcagatgcacgtaatattccttgggttaagaatgatggcgttgacttagtacttgaaagtactggtttctacacatcagaagaaaaatcacaagctcatcttgatgctggtgctaaaaaagttcttatctcagctcctgctggcgctgttaagacagttgtttacggtgttaatgatgacactatcacagctgacgacaacatcatctcagctgcttcatgtacaacaaactgtttagcacctttagctaaagcagttaacgatgctttcacaatcaaagctggtacaatgacaactgttcatgcttacacagctacacaaaaattacaagatggtcctgatcgtggtggaaacgtacgtgctgcacgtgctgctgctgctaacatcatccctcattcaactggtgctgctaaagctcttggcttagttgttcctgaattaaagggtaaacttgacggacatgcacaacgtgttccagttatcactggttcattaacagaattagttgcaactcttgacaaagaagttacagctgacgaagttaacgctgctgttaagaaagttacagaaggcaaccaatcattcggttacaacgctgacgaaatcgtttcatcagatatcatcggtacagaatttggttcagtatttgatcctactcaaacacaagttgttggtagtggtgaaggccaagttgttaaagttgttgcttggtatgacaacgaatcaggctttacagctcaaatgatccgtacattagaaaaatttgctagcttaatctaaatggcaaaacaaacagttgcagatttaaaagatattaaaggcaaaaaagtcttagtacgtgttgactttaatgtaccaatcaaaggcggcgttatcggtgacgataaccgtatcgtagctgctttaccaacaatccaatacatcattgacaatggtggcaaggctatcttactttctcacttgggccgtatcaagagtgacgaagacaagaaagaattgacattgaaaccagttgctgcacgtcttggcgaattattaaacaaagacgttactttcgttgcttcaaacgaaggtcaagaattagaaactgctatcgatgctatgactgatggtcaagtattagtaatggaaaacactcgtttccaagatatcgacaacgactttggcaaacgcgaaagtaaaaacgatcctaagttgggcgaatactgggcatcattaggcgacatgttcgtcaacgacgctttcggtacagctcaccgtgctcacgcatcaaacgttgggattgcaacagctatgaaagctaataacaaacctgcagttgctggttacttattagaaaaagaaatcaaattcttgggcgaagcagttgacgcgccagaacgtccatttgttgctatcttaggtggcgcaaaggtttctgacaagatcggtgttatcgaacatttattagctaaagctgacaaagttattgttggtggtggtatgacttatactttctacgctgctaaaggtttatcaattggtaactcattagttgaagaagataagatcgaattagctaaagaattaatcgaaaaagctggcgacaaattagtattgcctgttgataacgttgttgcagacgcattctcaaacgatgctaagacagaaactgttgaaggtaacattcctgatggctacatggcattagatatcggacctaaagcaatcgctgacttcgaaaatgttcttaaagatgctaagactgttgtttggaacggccctatgggtgtgttcgaaatggacaacttcgctaaaggtacattggcaattggcgaattcttaggtaacttatcaggcgctacaacaatcgtcggtggtggcgattcaacagccgcagttaagaaattaggcgttggcgacaagttaacacatatttctactggtggtggcgcatcacttgaatacctagaaggtaagacattacctggtatcgctgctatttcagacaaataaatgcgtaaaccaatcattgctggtaactggaaaatgaacatgaacccaactcaaacaactgagttcgttaatgctatcaaagccaacttacctaagtttgatcaaacagaatcagttatcggtgcacctgctgttgacttacctgctttattagaagcagctaaaggcacagacttaaaagttgctgctgaaaactgttacttcgaagaagctggtgcattcactggcgaaacttcaccaaaaactttgaatgaaatgggtgttgattacgtcatcatcggtcattcagaacgtcgtgattacttccacgaaactgatgaagatatcaacaaaaaagcacacgcaatcttcaaaaacaacatgacacctatcttctgttgtggtgaatcattagaaactcgtgaagctggcaaagctgaagaatgggtttcaaaccaagtaacagaaggtcttaaaggcctttcagctgaccaagttagctcaatggttattgcttacgaaccaatctgggcaatcggtactggtaaaactgcttctgctgaccaagcacaagaaatctgtgctgttgttcgtcaaacagttgctaagttatacgaccaaacagttgctgacaaagttcgtatccaatacggtggttcagttaaacctgcaaacgttaaagaaatcatgggcaaagaagacatcgatggtggtttagttggtggcgcaagcatggaacctgcttcattcttagatcttgttcactttaacgactaaatgtcaattattactgatattttaggccgcgaagtcttagactcacgtggtaatcctactgtcgaagttgaagtttatactgaagatggcggctttggtcgcgcaatcgttccttcaggtgcttcaactggtgaacatgaagctgttgaattacgtgacggcgacaaatcacgttttggtggcaagggtgtattaaaggctgttgaaaacgtaaatggccctcttgctaaagaaatcgtaggtttcgacacaactgaccaacgcggtatcgatgctgcaatgatcaagttagacggtactgaaaacaaaggtaaattaggcgctaacgcaatcttaggcgtttcattggctgctgcacgtgctgctgctgacgaattaggcttaccattgtacgaatacttaggcggccctaacgctcacgtattaccaacaccaatgatgaacgttatcaatggtggtgctcactcagataacaaagttgatttccaagaattcatgattatgcctgttggtgctaaatctgtacgcgaagctatccgtatgggttcagaaactttccaagcattgaagagtcttttatcagctgacggtaaagttacttctgttggtgatgaaggtggtttcgcacctgacttcgcaaacaatgaagaacctttacaatacttgatcaaagctatcgaaaaagctggttacaaagctggcgaagatatatcaatcgctatcgatgttgcttcatcagaattatggaacaacgaagataagacatacaaattacgttggtcaactggtgaagaattcacaacacctgaattcgttaaataccttgaaggcttagttgctaaatacccaatcatttcaatcgaagatcctatcgatgaaaacaactgggaagactgggcatcaatcactaaagaacttggcgaaaaagttcaacttgttggtgatgacttcttcgtaacaaacactgattacctacgtaaaggtatcaagatgggcgctgctaactcaattcttgttaaagttaaccaaatcggtacattaacagaatcattagaagcaatcgaaatggctaaagaagctggctacacagctgttgtttcacatcgttcaggtgaaactgaagatacaacaatcgctgacttagttgttgctacaaacgctggccaaatcaagacaggttcaatgagccgtactgatcgtttagctaagtacaaccaattaatgcgtattgaagaacaattaggtgatacagcttcatacaaaggtatcaactcattctacaatatcaaaaaataaatgaaaaatataaacgaaatttctcttaagatacttatggaagaaacaaatagttcatattggattatatatcagataatgaaggaaaaaacaaaagatgaagctcaacttaacatagcattgatgccattcttatcgtcagtctgtgatggatggatcatggtattcaaattgcagaattcggatatggcgttaccagagattaataatcttccatttgagaaatatgtgcggtcaatccgagttagctataagttgtattctgataagaaagtaaataagattaataaaactgttcataagtcaggtttagagagacttcggttgttagtaacagagtataatattattcaaagaatccgtattattctttggggacagcctgatttaggtgtgtatagttttaaagggaccccttacggaaatacgagtcaacttagtatttatttagataaactggtagatatagaatctactagctcgttatcagaatatcatgacagtttaggctcagtactaatggattattcttcaatacttagtacatttatcaatagcatcgttaatgatacgtttaaggataaggttggtttagaaaaagttggaaagttttcttcagttgaattccaacacaaagattatttttatcatgataaaaaaagaaaaaatatactaggtggcgctttaccaaaagatactcagttatttttgttcgatatatattgccaaaacaattttatcaataatgttatgccgttattctatagatctaaattacaaacctatctaacgagtattaatagtctgatattaattcaaaaaaagtataaaacacttattaataatgaacaggctagttctattgagaaacttattaacgaaaagaaagagtattttactttagaaaataaattacgaaacaatgtttttcattattgtattgaaggaatccctgtttcagtattcaaaaatccaaactgttattttaaggaattagttgagtattctgtgggaattgagtttaaagaatttatgagacgaatagataattcgttggatgaaatcaatcgaatattctgtaagataattatgtggaacgacaagcaatgaatgcatattgaacatgtcggtttatgggttcacgatttagaagcaatgaaggctttttatcaaacgatgtttcaagcgactgcgggtgagttgtatgagaaccacaaaaaagggttccaatcatactttttaactttcgcagatggtgcgcgtttagaaattatgcaccaagatagtgaactagtcggcttagcaactaggggccaatttgcgcacttagcgatggctgttggtagtgaaactgcagttgaccaattagtgactaagtttcaagcacaaggcttaccattgctaaatggcctacgagtaacaggtgatggttattacgaggcagtcgttcaagatccagaacagaatttaattgaattaacggtttaattaagattttaagcgatcaatttcgtctttgagcgcctgattttctttttgtttctttcggtaacgccagtagacgtaagccagaatcagtagaataagtgttaaacctgccaagatgtaaggccagtagtctgtttcaggcgttaagctgacgtctttttggttccacttagccgctgcttggcggctgattgtaaagtgacgtgtgaagtgccaggtacgaccttctgaacggactgttaaatcaagcgtgtaccggcctggtttaaaccgatcattaagcggtagatagaactgcataaccgagtttggtgcaaattggacttgctttttctcagtttgataaagcttcgtcttttggttacgcttggtgacaaaggcgtttaatgaggtttgattctggaatttaggttgcacattgcgaatattggcaatgatttggttggtccccatatgttgaccagttttgacagcaccgagtttgaattcaggtgtgacactttggtcattgctgcgggcaactactgcaactgcatacgcaaacttattacgcacgctaatctgctgtgttgtttttgctgttgttgggacttcagtcgcgctaatcccaccaactaattggcctttaaaagctttatcaggcgctgttaagcgaatattgacgactttttgttcatgagcggttaacgtaatattctttttggccggttttaaatgtttgcccaacggatatttgagtgttttatccgattgattcacgttatcgctgtaattgacgacgccgttaatattggtagtcgccgtgttagtttgcacacgaaccttaattggtttgtccttatgattaactaatttaatctggagatcttgttgttgcttgggttggacaactaaatcaaaataacttaattgtttgtcggcctgattgtcaggcggaataattgtcatcgcaaaatctgctacgggttgcgcggcttgagtggcttgcgcgtgggcgaagagggcaattaggccaaataataggccgataactagtcttttaattgttgtccgcattcaaaaactcctttgttggctatttgggctagcgattaaagtccatgtgatatctgattggtaatgtgctttgtcagttggattaacagtttttggtacgtggaggaagatagcatcactatctgttcctgatgttggtgcagtgcctagggttgctacaacgctcccgaaggatgtcgcgccacctttcataaaggtacttgcttggtcgttaacttgaaccgtttgatcgctagtcgttggtaaggcagcatcgcccttgttagcaccatcaattgtgacgtttggtgttttaaaccaaatgttaacgccggttaagacatcggaagcatctgcgtcacttgcgtcagtagtaccagcgttagcgaagtctgtttgggccacttgtaggtcccaaccgtctaatttagcttggctacgatcatcttgaattgaaacaacattactagtggcaagcgtgtttgctgtgccaatgtgagagccactttccaccgctgctaaatctttgtcagccgaacgatcgatttcatgggagccgaaatgaaagtctggaacagcggtaattactaatggattacttttttcagtgaagacaaccgctgcatcagtcgtttgtttttcaacttccgtaggagctgcttggatttggcctgctgacagaagagttgttgttgcgagtagtgagaataaagttgtgctaatcattgtttttttcatctaatcattgtttttttcatagtaggtcgcctctttcttaatgagtagaatagtggttaataataggagcaatccgctaagttgataatagcgtatatcggtaatactggtttgtggtaaccgttgtgttaatggtggtgcatattcgagtggtgtcatgtgccattcgttgtgaatggtgcccgcattgtcgggtgcggcaatcaaaggtggtcgtggtagggggacgaccggtagcgtctgctgattgctaaattgaattgtcgcactcgaactagcgggcacagcctctgctcgaatcggtgtgaataatagactaccacctaacagaaaagtgaaaaaatagcgtttatacatttaattgggggcagtgatgagcattaattctaattcagccgtatacggggttgtggtttgtttaggaccagctggaaattgggtttgaacagtttcgtggagtaaatccgtcaaatccgtttcatctgcgccgggttgaatcggtgcatgagcggcctttgaatagagttgttgcggttgtccggcaaccaatggtttagtagtctgatccttacgccaaactagggcattatcgagtgtggcttgaccagcggtaaaaggttgcttgagattgacttgaatagcccagtctccccgggtggtggcgcgtggatcagagacaatcagactggtatctgctgtcttagtataggggtagagaggactttgactattggtaagcgggagactgccaaaatcgaggtgagtcggtgctgctagaaagcctagcttaccagcaggaatatcctttagaacctttcggacaggcgttgtgagcgcgtatggtgctgggtagttagcttcaacaacaatctgattgggttgcgttggtaaatcagattcaaattgatagtcgaaagcctggttggcagccgctgctttagcagggccttttaataatgattgtcccgcggcgcttagaaagttcagcgtgagctcactggcaggagtcgcggtcccatttaaagcaaatttaaatttctgggcatcatcggtagggagtccaccagtgttgataagggtgatgatttcaggtggtagtggatcgtgcaaatgaagttgcgcaatattttgagtagaagtgagactttcaaatttcgttttgaaagtcgtgtcagaactgttcgttgtgttagtggtgccaatggtgctatcaaagtgaacgaatggataaatcgttttggtttgatccttttcagttaaactgacgccacgataaatggtgtgtggggattgaccagttgtgttttcaaggttaagtttaatgttttcaaatagtcgggttgcggcaaccgtattgttgttgatagtgacatcagaatcaccaattgtaaccggactgttgctaccactgaggccaaataagacagattggttagtggttgtttgattattaatagcgacttgactgttatcgccaattttcatgtaagaaccagcactcgctagtggaatgagcccgttggcaatactttgcgcaccgttgatggtgaggtcaataatactgttgtcacggaagtcatgcataagcggtcgcgcacctgaaacagctaaatattgaccaaaagtggctgatagttgaccaccaatatccaatttaagaccattagcttggatgttacggataaacgcatctttggcggttaaggtcatcttagaagtggtgtcggttgtcatttgcatgattggattaccacttgaggggttatagatataggcaaaaatatctttaccagcgttcaagttaacttcgctattgttagtggcacttattggactatcttgaacatatgcaccgaagacgtctgaattagaagcgagttttatcgtactattcttgtccgctgtaatggggcttttttgtagataagaggtaaagagattagtggttgattgaatatcgatcgtactgtcctgggttgcggacattggtgattgactttgtgcgtaataataaagactacctgccaatttcaaattgacatgaccattattagtggcagcaattgtgcggttagtcgtaccagtttgatagaagttgttggcctttgtgacattgatagtgccaccatctgaagcaactgctttagagctacttgatccagtgacaccgaagatatgccccccagcattgagtgataaattggaaccagacccttttgattcgatattaatctgaggaataccagcgcctgatgccgggaaaatagcgttgttggttgtaattgaaacttttgcaccaccggaaacttgaataccgggggcaataccatcagttgggttttgatcaattcggattaggccataagagccgccaccggcatgattgatggtcgttgtcccacctctaaagtctaaccggcctgtttcagccaattcttgtgaccaagtaccagcagtttgggtaatggtattgttaccactaaaggcgatcaccccctgcatgaaatgaagtgactgcgcactactgttatattcaacattttcgagcaagagcgtactaccatttgcgtaagactcatttgttgggtgacagagaccatagtagttattattattaattcttagatttgtaaatttgattgttttcttttgcataccagttgagccgatgtacagttgtgttgttggtgctaggacagcaatatcagcaatatttaataaatggcgctgtccggtcgttggattggtgccatcgatggtaatgtcttggggattatttttaccgatttgaattctagcaagcaagctttcgagcacattcaatgtgatatcagctgttagttggacgctttcgccattttctaaagccgcttttaattcggctgcattcgcaacgggcgtgagaccggctttgataccaggattttgtgtcacaagtggtttgattggttcaactggctcttgcggtggtgttttaatcggttctgattcagatttcgctgattcttcagttgttgagacggatgacgattcagcggattgcatattgcttggatcgtctggttcaacgaggactgaagattgggattcacttggtggggctgatgctgattcctcagcacgactaacatgaataggggatagtagtgcagtcgatagacttaataataagagatacgaaacgggggtcttcatatgatgaaaaaggtagatcgacagacacgtattgaacagattattaatcaacaagtgataacaacccaagaagaattattagcaacattaagagatgatggtattgacgctacgcaagcgacaatttcacgtgatattcgtgaaatgcagattgttaaggcccgggatgtgaacggggaattgcggtacaccgtttttcatgacgatgaacggacgcaagaacaacggttaaacgacaagttacgtgaagtcgccttgacgattacgcaggttcaggtgatgaacgtgattaaaaccgtgcctagtaacggtaatctactagcagcgttaatcgacgacttagggtatgaggatgttgttgggacgcttgctgggcatgatacaattgtggttatcagtcctgatgaagcacatgcggcagatttaaatcaacgtttttcagcacatttagcgggaactaaccgaaattaaatggcacattatctagaatttgaccatgtttcaaagatttatcgcggtggtaataaggccgttgatgacattagcttcacagttgatcaaggtgaattcatttgcctaattggcacgtctggttccggcaaaacaacgacaatgcgcatgattaaccggatgattaatcccactcacggcacaattacactggctggcaaatcgttagcggacacggaccccgttaaactacggcgcaaaattggctacgtcattcaaaatatcggattaatgccccatatgacgattcgtgacaatattacaatcgtgcctaaactattaaaatggtccgatgaagaccgtgaaaaaaaggcacaggaattattaaaactggtagaattacctgctgattttttagatcgttatccaagtcaattatcaggtggtcaacaacagcgaatcggtgttatccgagcgttggctgctgggcaggatattattttaatggacgaaccatttggcgcacttgatccgattacacgagaagcactccaagatcttgttaaacaactccaagttgaaatggggaaaacagtgatttttgtaacccatgatatggacgaagcactcaaattatcatcacgaattgcgattatggatggtggcaaaatcattcaatatggcacgcctaatgagattttacgacaaccagccaacgattttgttaaggacttaatcggtcacgatcggttattggaagctaaaccaaatgtcgaaactgttgggcaaattatgctgaagacaccggtcacgattacgccagatcaatcactgagttctgcgattaaattaatgcggcaacgacgggttgatacgttgttagtcgttgacgaccaacagctgcttcaagggttagtggatttggaaaatattgaccatcattacaaagatgctggtaccgttcaagatatcatgtcgacgaaggtcaactttgtgaatcaaaccgatctggtccgcgatacaatcgaacggatattgaagcgtggttggaagtacgtgcccgttgtcgatgatgaccatcgcttagtggggattgttacgcggacagcgcttgtcgatgtcgtttacgacgccgtttggggcgatgacgagccagacaatgcaacagactaaatgcttaattttttaaatcaaaatggggccgacttgctaattaaaacgtgggagcaactttacatctcggccatcgcgttattgttaggggcattagttgcagtaccgctcgggattgccttaacgcgtgttccgaagacggctaaagtcgtgattgcgatagctagcatgctccagacggtgccgtctttggcgctgttagcgttaatgattccgctactcgggattgggaaagtaccagcgattgtggccttgtttatctattcgttattaccgattttacgcaatacctatattggcatgaacgatgtcgatccggtgttaaaagatagtgctaaagggatggggatgacgccactccaatcaatcatgcaagtggaagtcccgatggcaatgccagtcatcatgtccggtattcggttatcggcggtttacgtcatcgcttgggcgacactagcgtcatatattggtgccggtggcctcggcgatttcatcttcaatggcttaaacctatttaagccagacttaatcatcggcgggacaattccggtgacgattttagccttgttggttgatttcttacttggtcgtcttgaaaaaagaatgacacccgttgccattcgctaaatgttgaaaagattaaagaaaatcacagtcttaacgctgcttggtggctgccttttgctattaggcagttgcgggttgcccggtcttggtggctcggcgaaggacacgattcggattagttcccaaagtacgacggaatcccaaattttagccaatatcgtcagtcaattgattgcgcatgaaacggataacaaggtcgaattggttaataacctgggttcttcaacggtgacgcacgaatcgttaatccgcggcgatgcggatattgcaacgagtcgttatgcaggaaccgagatcactgggacgttaaaaatgaaaccaacgaaggatcccaaaaaggcgcaaacaattgtgaagcgcgaatttaaagaccgttaccaacaaacgtggtttccaacgtatggctttgccgatacgtacgccttcatggtgacgcagcaaatggctaaaaaataccatcttgaaacggtcagcgatttgggccgggtggctaagcaattaaccgctggcgttgactcggtgtgggtcaaccatgaaggggatggctaccaagaattcaagcaaacttacggctacgattttaagaaggtagcgccaatgcaaattggcttagtctatagcgcacttgcggccggtaaaatggacgtcgttttagggtattcgactgatgggcggattaagagttacaacctgaaggtcttaaaggatgaccggcactttttcccaccatacgatgccagtctagtggctaccgatcagattttaaaacaacatccagaactgaaaccactcttaaaccggttatccgggcaaatcaatcttgatacgatgcaaacgctcaactacaaagtggataacgacttgctagaacccgctgtggtggctaagcaattcttgacgcaacatgattactttaagaaaggagccaacaaatgaatgacgcatttaaacacgtggcaacagctactttattatttccaacataatggtggttacgttttaagccaatttaaccggcacttcttaatttcaatctatggggtgttactagcggccatcattggaattccgattgggattttgattgcgcatcgtaaaaaaatgagcgatgtggtaatcggtattgccaacgttattcaaacggtgccgtcgttagcgatgttatcgatcatcatgttagggttaggcttaggcactaatacggtgattatgacggtctttttatactcgttattaccaattatcaaaaatacgtataccgggatgattaatgtctcaccaaatattctggattccggtctggggatggggatgaccaagtggcaattattgacgatggttgaattacccctgtccttagctgtgattatggcggggattcgtaatgcgcttgtagtcgcaatcgggatcaccgcgattggctcatttgtcggcgccggtggtttgggcgatattatcattcgagggacgaacgcgaccgacggcggtgcgctgattttagccggggccttgccaacagctttgatggcaattatcgccgatctcgttttagggttcattcaacgccgtttagaagcaccacaagcacatcattaattatgaaagataaggttcaaatgcatcaggaactggggctgtgacggttcggggttgatccgtgtaaggttctgtataccgcaacgtctgaccgtgtagtaagagccgcggtgttgtatccgtcgggttatagagtggatcacctagaattggatgaccaatactagccaagtggacgcgaatttggtgagttcggccagtttcaaggtcgaccgctaatactgcagttgcgcccttccgacttaaaacgcggtagtgggtaatcgccgataaaccgttgatgtaatcaacacaacgttgacgatcattttccgggtcgacaccgatgggggaattaattgtggcgtgttctgctaattcgtgttcgggatcattgacgatagcaatgtactggcgggccatctttttttgactgagttgacggtttaaaattccgataacaatcggcgttttgccaatcaataagacgccgctagtggcttcgtcaatgcggtggaccatgtaggcttttttcccttgttgggcgagataaaaggcgacttgattcattaatgtcccgttttcgccagggcggttgggatgggttttaataccagcaggcttgttgacgatcaataaatcgtcgctttcaaataaaacactgaatgattgtgtcgcatctagttcgtagttttgaactttgacggacacttctgaaaaattcagcgtgatttcatcgccagattctacgttgcggttaaacgcgcggtattgtccgttgacgagtatttcacgattaatccgcaagaagtgttgcattttttgcggcactaaccagtgattgagaagtccgcggactgacatcggactaaagtctgtttctaaagttacttttttttggtaaattatcatatgaataagcaggattcgccgatttggttggcgattaaacgtttttttaaacgggcgtggcgagtcgtgaagtatgtttggtatcgactgcaattaacgcgatggttgattttgggcatattacttttagtatttttcatgagtagctacttaacctttaaagcaaaaacggctaacgttggggaaattaaggccaacttacaaacatcaacaacactttatgataaaaaagatgcgcgggcgggcaccttatacacccaaaaagggacgtacgttgaattagataaaatttcacctgagattcaaaatgcggtgatttcgacggaagatcgctccttctatacgaatccaggctttagcgtcaagggcttggcccgcgccgctgttaacttagtgattcatcatggtcagattaccggtggggggagtacgttgacccagcagctcgccaaaaatgcgaagttgagtcagaagcagactttttcacggaagtttgaagaacttttcctagcggttcaaattacgaagacttactctaaaaaagatattttggcgatgtatttaaataatgcctacttcggtaacggggtgtggggcgttcaagatgcttctagacggtacttcggtaaaaacgctagcgaattagatgctagtgaagcggctgtgattgctgctatgctccgaagcccaagttactataatccggctgatcatttggataacgccacatcacggcggaatttaattctcggtctgatggttgataatggtaaattgactgagagtcaagccaaggcagccaagagtgaaacattggtcgttaaaaataccttggaacaaaacgatagttacaaatacccttactactttgatgaagttgtgaatgaagctgttaagcggtttggtctcaaggaagaagatcttgttaaaaacggctataagatttataccgcactcgatcaatcacaacaaagcaagatggaaaataccttcgagcaaaattggttgttcccagacaatgcggctgatggcaccttagtgcaaggcagctccattgccattgatccgaaaacaggtggtgtgtcggccgttgttggtgggcgcggcgattacacgattcgcggttatagtcgaatcactcagatgaaacgacaaccgggatcgacgattaaaccgttggcggtttatacaccagcgttagaagatggctatcactacgattcttctcttcaagataagaagaagagttacggaactaataaatatacgccaaccaacccagacaatgtttataccggttcgatgccgatgtatcaagcggtggctaacagtacgaatgcgcctgctgtttggttgttaaatcaaatcgggcttaaacgcgggattaagtcggtggaagatttcggcatttcagtgcctaagagtgaccaaaatctagcgatggcccttggtggttggcaaggtggggtttcaccttatcaaatggcgagtgcttatacagcttttgctaataacggggaactttccgagacccactttattcgaaagattgtggatgccagtggtgctgttattgttgataacacgacaccatcgaaatcgcgaatcatgagcaagaagacctctaaagaaatgaccagcatgatgttgggcgtttataacagcgggactggtcgatatgccaaaccagatggctatcaagtcgctggtaagtctggtagtaccgaagtacctgacagttacggttacgggacgaaggatcaatggttaatcggttatacgccggatattgtggttgcgacttggatgggctatgataagacggatcaagaacactttatgaaaaataccagtatcgacggcctagcgccgatttttaaatatgaaatgcaacagttattaccaacgacggcccaaaccaactttgatacagaagacgcccaatcgatggctaaaaaagaagacgatcaggattctgataaggttgtcaattcgcttcaatctggaattaaagatggtgtaaataaagcgaaagaaacggtcaatcaatggtataataacttgaaaggtttttttaattaaatgacagtcaatatttatgatgatgctaaccaaatggcaactaatttacaaacattaccacaatttttaggcttgcaaaatgcttttgcagcacttaagaaggatgatattgccttcacaatgttcaagaaattccaaacacaacaaatgactttacaacaaaaacaaatgcaaggtgaagaattaacggatgacgaaatccaagaaattcaagaacttgctcaaaaaatcggtgatatcgatgccatcaagaacttgatggaacaagaacgccaattaagccaattgatggatgaattaaaccaaattatctcaaaaccaattgctgatatctaccaaggctaaatgaaatttattcacgcggctgatgcgcatattgatagtccgtttgtgggactaaaaaaagcgtcaaccaatttatggacgacgattcacgaatcaacttttaccgcctttgaaaaattagtgcagactgccattgatgaagctgttgattttgttttattagtgggtgattcatttgatcaagaggcccagagtttgcaggtccaaaactttttgaaacaacaatttgaacgcttaaacgctgttgaaatcccagtttatctcagttacgggaatcatgattactgggatcccaatcaaattcatttcgattttccgaaaaacgtccatgtttttacaacggttgttgaagctaaaacactaacaactaaagcgcaagaaacggtcacgattgttggttttagttacgggcaacggtggttagaaacggatcaaacgacacaatttccaccacgagctgccacgacttatacaattgggactttgcatggtagccagagtacggcatctgatgcggatcattacgcaccgtttacgttaagtgaactcaaccaactacaatatgattattgggcactaggacatattcataaacgccaaatcttacaagaacggccttatgtgatttacccgggtaatttacaagggcggcataagaacgaacctggtgaaaagggtttttatttagtgacagctcaatccggtcaattcgagcttgaatttaaaccgacgacggtgattgaatggcaacggcaacgatttgaaatccctgaaaatccaagcttgaatcaattgcaagaagcgttgagtcagcaattagcacagagtgaaacggcgagtttggtggctttggaattgacgcacgctgaacggttatcgagtgatttgattcaacgtgtcaataatggcgaattactcgcttatttacaagcagcccttgagtctagcgctgtcatgcattggccatacgcgcttaaactacagtttgcggcccaacaacaatttagccagattgatcaggcctattggcaagcggcggctgataagatctttacgccagattacatcttggaaaaggcccaaccgcttctgaaagaaaaattcatccgagaagcacttgaagaacccgattttcaagaggatttgaagaccgcggccgaaacgattctacaagaaaagaagctggaggactaaatgcggattaaaacaattaacatctttggctttggtaagtggcacgatcaaacaattgatttgcaaaccgattaccaggttttatacggtcaaaatgaagctggtaaatcaaccatcacggcttttatcaaaggcgttttgtttggttttgcaactggtaagcaaaagtatgaacaatacctccctaaaagtggcgcgcagtatggtggcgagttaatcgttgaccaccacgatcgcgagattacgattcggcgggttgctggtaaagccggtggcgaggtaaccattattgatcagggcaaggagtttggtgcggattatttgaaccaattgattgcgcccgcagacaaagccctctttacgcaaatttttgagaccaatcaacaggatttaaatcagatttttgggctaactgccgatgattttatgcaacatcttttaacgattggtgcggttggtagtcatgaatggctcgcttttgaagctagcttagataagtctagtcagcaaatctataaaccatccggacgcaagtggccacttaataaggccttaaagcagtatccggaaatcgaacaggctgttagtcaagctaaagcggctaatcagcaatacgaaagtaacgaccaacaattacaacaggcactacagacgctgaagcaagatcaggcagcactagctgaagttcagggacaaaaaaaccagcagcaacaattactagaacgctggccgaagtatgtagaatggcaggctttacaagcgtctttagcggcgacaaaaccttttgacagcactttgtatgcgcaatatcaaaaaatcgaagaacaacgccaagaatctcaagcagcattagcggatgctcagcaagctgtggcgacgattcaagaaacgcttgatcaaacgggagaattccggttctatcaaacacaccaagcagaaattgatgggttattagagcaatggtcaacacggcaaaagcaagcgcaacagtcagccttgcaacaaacccagttgacgcagttgacgagcgaacaagcggcattagctgccaagtatcaatggtcgacggctgaaacattaccaacggttttaagcaccgaccagctagaacagttacaagttgccaataccacctacgaacaaacgcaaacgaccaaccgcgttttaacggatcaattaacaaccttgactgaccaggtggctgaacaagaacaattagtgaccactttagaaacaccggcggaagttgctagtccaacaccgatgagcaatatttgtttaggattaggggttgttggtttattaggcctttttttaccggggggcttgaaagcaattgctttgttaggactcgggttacttggctatgggttatacaccaagtatcaagggcaacaaaagcaaacggctgggacagcgcaaaaggcgcagtggcaacaagcactcgctaaactcgatcagttacaagccgaccttcaggaaaaacaaacagcacttgcagacgggcagcaggctttaagcacaagtcaacaacaagtcgctacgcttttaagtgcgaatggttatccgaacgaagcaacggtgacacaagtcatgaaccaacaagatgccttggcgcggatgcaacacttacaagcattaattgcccaacaaagtgctgaaattaacgcgagtcaagctgacttaactgattattttgaacagtttgcgtttgcgcacgattggctaggggcgcttcaaggcgaaccactgcataatttggcgcaaattgaacaatttaaggaccgacttgatcaattgaaacaagctctcgcacaagataatgaacgttatgaatatcaacaacaacaagtgacacgcttgcaaagacaagaccaagaacgacaagcccaacaagctgacttgcttgaaaaagcccatctcaaaacggccgctgaactagcgcaatgtgcagccgctgaacagcaacgccaagtgcaacaacaacgtcaaatagatcttgaacatgaattgacaagttatttgccacaattacaagcttttgaggaccaagcagacctcgaaacggcaattgcacaattaacgcaacaaacggcgacgttaacggcagcaattcaaacacaacaacagacgattgccgagttacaagttgttcagcaaaagttagttgatagcgatgcttatcaacgacaaaagcaagcacaattaaacgctgaagccgacattatcggtttagcacaagattggttggctaaacaattggcaatcgattggattcaagcgaccctaacagcagcttcacaagaacgattcccacgtttattagcaaaagctacgcaatactttgcaattctaacgcagaatcggtatattgaaattactttcgaagcggcaactttaactgtccttcgacaagaccaggttctatttgaagtcggcgaactttcacaaggaacggcagagcaattatacattgcattacgttttgcgtttgcagaagagattgccgatgttgtctcactaccattattggtagatgacgggttcgtcaatttcgatgatcagcggcaagcagcggtttggcaattattgcaaaacctcagcggcgcacatcaagtcatttacttgacggctaatccgcgaactgaggccgcctttggcacggaacactggttaaacttagagaaggtagggttagcaaatgacgactaaatgacgactaaaaagctatttgattaccaaaatgatgaaaacttagcgctatttgttttaattaaagcagcggatgtcagagttgctaaaaacggcaagcaatttattgccttcacattccaagatcaatccggacaaattagtggcaagtattgggatgcttctgatgaagatgtggccttatttacaccggggaagattattcatctccaaggtaaacgggaactttatcaaagtaatccgcaaattaagatctataaacttcgattagcgactgaagaggaaccacaggtcattgaacaatttatccaaaaagcaccggtacaaacggccgatatggaagaagaaattagccaagtgctttttgaaattaccaatcctaattggcaacgattggtgcgccacttgattcaaaagcatcaagcggacttcttcagttttccagcggccaagactaaccaccacgcttttgcgggcgggctagcctaccatacgttatcgatgttgcgactagctaaaacaattgccgcccaatacccacaaattgatgcggcgttattgtattcaggggtcttgttgcatgatttaggtaagacgcttgaattatcggggccggtttcaacggaatacacagtgcgcgggaatttaatcgggcacattgtgttagttgatgaagaaatcgttaaggcttgtgagacgctaaaaatcgacatcaatagtgaagatatgttagtgctgagacatgttgtcttagctcatcacggtttaatggaatatggttcaccagtgcgaccacaaattttggaagcagaagtacttcatcaaatcgatgaaatggatgctagcattacgatgatgacccaatccttgcaacatgcagaagcggggcagtatactgagcggctctttgcaatggatggacgtcatttctaccgacccgttaacgatcaacaattaacacaggattaattattttgatgatgatttagctgatgatttcttagcgttaacgccgtagcttgaaaggatatctgataaatctttatccttgattgttacgtcggctttcttaagaaccttcgtgtaaaccttagccatcactgtttgatcattagcccacttagcataaacttggtcagttaatgtcttcttgtgatcagccatcttacctttaccagggttcttgatcatgcggataacgtggtaaccatatgatgtcttaacaggtgttgttgtgtattcgtttgtcttcaacttgaaggcagctgttttgaatgttgaatctaatgatgtatctgtgctatcaaagacaggtaatttaccgccgtctttcttagtaccagtatctgttgagtacttcttagctaaagcagtgaagtttttagttgagttgtctttcttaagttcagaaataactgtttcagcagtatctttcttttcaactaagatatgttgtacttcaacttttggttcgtatgttttccattgtttcttcaaatcagcgtttgtcacttttttgttagcttttaaagcagcgttagctaacatttgagttgtgatttggtttttgaatgaagatgttgttaaaccactttgtgcaagtactgaagtgaaagatgaaccgtattgtttcttgtaagtattgtaagtcttgtcgattttcttagtaagactcttgctaccgtattgttcttgaagtgctttttgcaagatcatttgttgtacttgttgcttgccggcagaagtttccttaatttctttgtagaattcgtcttgagtgactttaccacccttaagagttgcgatagtgttgcttccacaacctgctaatgtaactaccattaatagactggcagcggctaatagccattttttcatcatttatagcgcctttaaatcgtccgtaaggcgtttgattgattctgaaatttgtgcaacccggggttgagcttcaaacgaaaaagtttgaacagcatcgctgatatcagcgagtgaatcaacagctgttgttttgatttcgttagacagttgaccggccgtgttttgtaaatctacagcgctactttgaacagtttgtgcttgcatggtaacgtcggttaaataatggctgattgcttgttgacgttctaagcccgtttttttagcggttagtaacgcataggttgtgccaagaaggccaccaatcagtaatccttttgaaaatgacatttaagcctccaattgttgcttaatcgcgtcagcaatcgcttgtagcttctctggtgtataatccgctgagttatcagcaaattgcattgagaagccgtctgctgccgtgtaacgagggagtaggtggatatgagaatggaaaacggattggtaagcaacctcaccgttattattacaaatattcatccctttaatcgcgggattgctggccttgattgcattcgcaatcttgggtactcggctgaaaaccgcagcagctaagtcggcgtcatattcgaaaatattggcaacatgttgctttggaatgaccaaggtgtgaccgggtgtggtctgggtgatatcgagaaatgctttgacaacatcatcttcatagacgacagtgctcggaatttcttgacgaacaattttacaaaaaatacaatcatccatatgagtttagaaattaaccaattaacgggtggttacgcccacgtaccagtgctccaagaagtaagttttacggttcccaatcaacaggttgtcggcttgattggcttaaacggggctggtaaatcaacgaccattaaacatattatcggattattaacaccgcaaaagggcacgattacgcttaatggcgtcacgttgcaatctaatccggatcaataccgccaaagcatggcttacgtgccggaaacgccagtcctttatcccgagttaacattacgagaacatctggaactaacgatgatggcttacgatttagatttcgagaagacttgggccaaagcaatggtgttattgaagaagttccgactcgacaataagctggactggttcccagttcatttttcaaaagggatgcgtcaaaaagtgatgatcgtcaacgcttttatgactgacgccgatttattcatcattgatgaaccttttacaggtcttgatccactcgccattcacgatttattggacattattgctgataaaaaggcggcgggggcggctattttgatgtcgacccatattttggccacggcgcaacaatacgccgattcttttgtcctattgaatcaaggcaaggtccgaacaactgggacgcttgaagaactgaaagcagaatttaacatggcagatgcaaacttagatgatatctatttgcaaatgacgaaagaaggttaaatgcgacagttatggcaaaaacgtgttcggcaacatattcaagaacaagttaaatatctcaaactggtttttaacgaccatttcgtcttagctttaattttcctactgggcgcattaggctatacgtacgctaacgccgtcaaagctttggatccgtccgcatggtggctgaaattactattgagtctcgtcttattagcggcagttagctttgggcgctttgcaacattacttaaagaagcggatagtgttttcttattacctaaggaaagtgatttacctgtttatttaaaagcggcgcggggttacagtgcctggctgccggtaatttttaccgggctagtaacgggattaattgcaccaaccctgctgattactaaatccgtaccgagctggcaattactcctagtgtgggccacattaatcgcgattaaagatcgccgcttttcaaatcaattattgaattggtaccagatagatgccaaagtgcctaagattgtttggttactagttgattggttgttaatcggtagtcaactctttagcggctgggcaatcgctggggttttaatcgcaatcggcttggcttattatcaacgacgtcaattgacaactattcaacagacaacattgtttgattggttggcagcggtcagcgcagaagattctagaatggggcgcatttatcgcttatacaacctttttacagatgtaccggggttaaatagtcaggtcaaacggcgccgttacttagattggctattgccagttgctaagcgtagtggtaatccatatttgtatctctacacacgtggttttattcgcgggactgagtttagcggattgtacgttcgcctagtggttttaggaggcatcattctatgtttcagccatctgtggtggttgagcttagcactaggtttgttattaatctacttagttggcttccagttactaccgttttatactcaatatgaacaaattatttttacccatctatatccgattgctaagcaagctcgcgtgaaagctttccaacaactgttattaggtttattattgtgccaagccatcttgtttagcgtgatactgctagtgacgatgggcttgaacctccaagttgggttaagtgttctggcgttattcgccttagttggtgtttttgttcagttctatttaccacaacgattagttaaataaatgaatttcgacttagataccggttggcaagtacgttcagctggtggtgatacgggtgccgcttatttaggcgtccgtgcgtcagagaagatatttttaaaacgaaatacgtcgccatttctagcggctctttctgcagaaggcattacaccacgtttaatctggactaaacggatttcaagtggggatgtgttaaccgcacaagaatggctaaatggtcgtacgctcaagcgtgatgagatgaatagtccgcaagttgccaagttattggcgcgggttcatcaatcccatctattaaaacgcatgttacaaaaggttgggggtcaggtctggcaagcaccagagatgttgcagacctacttctatgatttaccgcaggatttgcggcaacatccttttttagcacaaacgagtcagtatttaaaagacacgatgtcagcattacaaacaccttctttagaggtgtgtcacggcgatttaagtcataagaattggttgttatctgatatcaatcgtttgtacctagtcgattgggattcagcaatgttagctgatccagctgtcgatttcggaatgattttatttcaatatgttccacgtcaagaatggcaagagtggcttgaaaactacggtttagaggtaacgcctgaattattgatgcgcgttaactggtatggtagtttgaacctactccaaagcattaagcaccattatcaacgtggtcgttttactgaaatgaaccatgacatattgcgtttagaagaagttctttctgaaataattaaaaaaaattaaatgcgtttaagaaacaaaccttgggcagcggatttgatcgctgaaaatccagatatgatcttggtaagcccagaaaatattgccggtaactggcaaagtcgttttgccaaggaacaaccaatctatatcgaagttggttcaggtaaagggcaattcattactcaaatggctcaaaaatacccagaccgcaacttcatcgcggttgaaattcaagaatcagcgattgccgttattttgcaaaaacaagttgaattaaaactccctaatcttcaattattgttaggaaacggggcagcattgacaaccttcttcgccgaaaacgaagtcgcaggggtttacttaaacttctctgatccatggcctaaaacgcgtcatgaaaaacgacgcttaacttataagtcattcttggctgaataccaacaaattatgcaaccaacaggttatttacgtttcaagaccgataaccaaggcttgtttgaatactcattagctagtttaaatgcatatgggatggtttttgacgatatttcacttgatttacacaacagtgatttagcagaagacaatatccaaacagaatacgaagaaaaattcagcaagcgcggtcaagtcatttacagattagaagcgcactacaaatagttaaagttgtgaaaactcaatgacaacccccgttttagcatcaactttgaagtgaaattgatttgtgccttcatcacgttcgcagatgatgccgccttgataaaccgggaaagtccgtttgttttgtgaaaataggtgaggactttcttcaatccatgagccgacgatttgcccttcatgacgaaggcttgctttgacatcttctaaaatcttgtcgagcttaaccatcttttgttgggttttatattgtctggtgccggctgctgccgcaacggctagtccgaaaccagttaagagatattttaacgtttgactattttttttcaaatgaaagaattcgcaaagatggcagaaacaaatctaacccatctcattaccaaaggaaaacatgtcttattttttacagcaacgtggtgtagcgactgtcggtttattaaacccgcaatgcccgaaatcgaagctgaattcccagaatatgaatttatcgaaattgatcgtgatcaatacatcgatatttgtgaagaatgggaaatcttcggtattccaagctttgttgtgattgataatggccgtgaagttggtcgttttgtgaataaggaccggaagacaaaacgtgaaatttcagaatttatccactcattaagttaaatgctaattgcaagtatgaaccaaaaatcttttccaaatattctcgttgtgatgacccaaccagatgttgctaatcaagtaacgactgagaaacaatcaattgtcagaattagcgaccaagcagatcagacaattggctataactttttagcaatcgatcaattattacctgaattacaatttaacggggtccaagccctcagtgttgcggatgtcgcaactttaaatcaagcacttgaagctgctggcttcacacctgatttagttgctgatgaaacaccacacatcgtggttggttatgtgcaggaatgtgtggttcatccagattcagatcatatgcacgtgacacaaacgcaaattgcacctgatcaaacggttcaaatcgtttgtggggctgctaacattgcccaaggtcaaaaagtaattgtcgcaacagttggcgcagtgatgccagaaggtaaaatcatctggcctggtcaattacgtggcgttcaaagcgacggcatgatttgtgctgctcgtgaaattggcgttgaaggtgcacctgctaaaggcattatggtcttaccagatgattgggaagtcggccaagcagtgacggctgatgcagttgccgcactattaaaataaatgtgtgggattgtcggatttgctggtggattgtttgatttaccaaagaaaaaagaagtattgaaccaacaaatggatgtcattaaacatcgtggcccaagtggtgcgggtgatttcattgatgataaagtggcgcttggtttccgtcgcttatcaattattgatttaactaaaggtgaccaacctatttataatgaagatcatactaaattgattttctttaacggtgaagtatataactatcgtgaaattcgtaaggaattggaaccattaggtcacgaattcaagacggattcagatactgaaacaattttgcatgcctatgaacaatggggcaaagatgttttgaagaagattcgtgggatgtttgtgttcgtgatttacgatttacaaacgaagactttatttggtgcccgtgatttcttcgggatcaaacccctttattacacaacgcttgatgatggcacctttatgtttagtagtgaaattaaaacattcatgcgtcatccagaatttaagcggacattaaacaagaaggctcttaaatcattcatgatgaatcaatataatgatttacaagaaactttctttgaaggggtcttcagattccctgcaggtcattactttacttacaaagatggccaattagatattgaaaagtattgggatatgcaatttgatccttctaacttatctttcgaagaagaagttaagaaaattgatgcttctgtcgaagaatcaatcaagatgcacaacgttgctgacgtaccagtgggtgcctttctttcagaaggggtcgatagtagttatgtaacaagtatcttgcaaccacaagaagtctttagtgttggttttgacgaccaaacttataacgaagtaacagccgctcatgctttggcagacgaactgggcttgaacttcaatgaaactaaggttaaagcggacgatgcgtttgctgaatttgataaaatccaatattacttggacgaaccagacggtaacccatcatgtgtgccattatggttcttatcacgttttgcccgtgaaaaagtgaccgttgcactttcaggtgaaggtgctgatgaattgtttgccggctacgttaactacgggatgcattcacacaacacaacgatcaaggctttcacatctagtttgaagaaattaccaaagggtgcccgtgctaaattggctaagacagtcaaaaagatgccagcattccctggtcgtgttcatttatatacgaacttggctaatcctaaggaattctatgccggtcaatcagtaatttatgatatcgaaaatccaagtattttcggttcagatgaagccaaccaatacttgaaacccgcttatcaaaatgacacaacaattcaagaaaattatcaagcagactttgaccgcgtcaaagatgctgatcccgtttcacaaatgcaatacattgatatgcatcactttatgttaaatgatattttacaaaaagctgataaactatcaatggcgcacagtttggaactccgggtaccatttttagacccagaagttgctaaaactgctggtcaggtgccaactgaatacttgattaacagcaaggatactaagtatgcttaccgtcaagcatctgctaagcatttaccagccgcttgggccaacagacctaagttaggtttcccagtgccaattaagcaatggttagaaactgacaagtattatgaacaagtgaaggccctctttagcgaagatttcgtgagtgaattcttcgatcaaggtcaattattagcgttactcgatgctaataaggaacaacgcattaacgggcgtcgtaagatttggacgatttacacattcttaacatggtacaaggtttacttcatcaacatcgaagattatttagtattaggttaaatgataacaagtgaaacggtttaccactttgtgggcattaaaggatcagggatgagtgctttagcgctcgtattaaatgatttaggctatcaagtacaaggctcagatatcgaccaatatacctttacacaacgggatttagagaaagcagacattaagattttacctttctcagccgataaccttcacgaaggcttaacggtaattgccggcaatgctttccaagatgatcaaattgaaattaagacagcgctcgaaatgggcttgccagttgtgcgttatcaccaattcttaggcgaactcttaaaaaattatacaagtatcggtgttgctggtgcgcatggtaaaacaagtacgagtgggttactagcacacgttttaagtggcgttgccaaaacaagtttcttagttggtgatgggacaggtaagggcatcaaggatgcacaattcttcgcttttgaagcggatgaatatcgtcgtcatttcttagcttactcaccagattatttaatcatgaccaacattgactttgatcaccctgattattatacggggatcgaagatgttttcgatgctttccaatcagaagcttacaaggttcaaaaagggatttttgcctggggcgacgatccagaattaagaaaactaaaatcaaacgcaccaatttattactatgggactaaatcaaatgatgatttccaagcacgcaatattcaacggactgttgaaggatcagaatttgatgcttattatcacgatgaaaatatcggacattaccacgtgccattatacggcgaacacaacgtactcaatagtttagctgtcattgccgttagttacctcgaaaaaattgatggtcgtgaagttgcacgtgaattggcagatttcaagggtgttaaacgtcgctttactgaaaagaaagtcgcagacgttaccattattgatgactatgcacatcatccatcagaaattaaagccactttggatgcagcccgtcaaaaatatccagatcgtcaaatcgtagcggtgttccaaccccatacatttacacggacaattgcattgatggatgattttgcagctagtttaaacctcgcggatgaagttttcttaacagatatcttcagttctgctcgtgaaaaatcaggtaaggtttcaagtgctgatttaggtgctaagattactaagggtggtcgggtccttaaattggataatatgtcaccattattagattttgaacaaccagtagtcgtcttcatgggtgccggcgatgttcaaaaatatgaatatgcttacgaagaattattaagcaacttaagtcctaaggataattaaatggatggaagacgcgttgtcaatgtcgatagcgaatcacgattttttagtaaagtatacggattaatggctttaggtgttggtatttcggccctcgttgctgttttactagtcacagtttttgcaagtcaaaccgtagccattttaagcaatagtaatacttggatggtctggggattaatgattgttgagatgattttggtcgttcagatcagtcgcaaagcaaccaagaatccgtcagcatcaatgatgctgtttattgcttacgccctgttgaacggattaacgtttacggtaatcttgttagcgtataacatcggtcagattggcgccgcatttatttcaagtgcgttagtctttgtcgcgatgtcagcttatggccggatgacgaagaataacttaagtggttttgggaagtttgccatgatgggcttgattgggattattattgtaaccatcgtcaatgctttcatgggctcagctgcaattgagtacttcttatcttacgcgatgttaattgtcttcattattttaacagcctgggataaccaaaaactaagcttgttatatcgtcaatacggttcaactggggaagtttcaatctcaggattagccgtgatgggtgctttaacgctttatctagatttcgttaacttatttattacaatgctccaaatctttggtttcggtaatcgagactaaatgaacgcgcaattaaagaaggggttgttagaattttgtgttttagcaacgcttaaaaaagccgattcctatggctatcagattattaaagatacttcaagcgtcattgaaatctctgattcaactttgtatcccatcttaaaacggctcgaaaaacaagaacagattgaaagttatcaggtggctcataacggacgtttacggaaatatttccatctaacaccaattggggcggctgcgattgaacagtttttaaatgaatggacgcaagtaacagcaatctatgagtatattaaaggagaagcataaatgactaaaaatgactttatcaaagacttagcagcagctttaacaagctatggtgtgagtgatgctgccaatacaattgattattacgatgaattgattgatgatcgtattgaaggcggtgaaactgaggcggccgtaattgctagtttagagacacctcatcaaatcgctagtcaattagcagatcagtttcaaccaacacaggttcaacacaaaagaatgtcgccggtattgttagtaacgttggtcgtattgttggtgttgggttcgccactttggggtagtttgttgttaaccgcaatcgttttactcgcggttggttatttattactatggattgggccttttatcggtggtacgctggcggttgctagcatcattggtggggccgttagcttagttttttcatgttttgtcacgttaaacgaaggtgcggtagtcggcatgatgcaacttggtattagttttgcgatggtgggtgttggcatcttaatcggcggtttaacgtggtatttttcgaaatatattgtgcaattttcaatcagcttaacacggtggttgattcggaaaagtaaaagacaatcaaaggcggtggcatagatgttcgcaaaaattcgaatgaattggtttaaaattgggttattgatggttatgattggattgctgatcatgggcgtgagttatgcgcttggtggttttgatagtcatatttttcaagagcagggcaatcatgattggtttagaacgtttaatttttagctatttcaccaacaaaacgttagctttagcgtggctgctaacgtattgggcgaccgaaccgaccagcatccgttcaatagcgcctttaccggtaattcctaagacgatgaggtcaatgccaaattcctcagggatgcgaatcgcaatttcttttttaggagaagcaacttctagaattggggtaatcttttcaaggccgtggttgtgcgcgtaacgcacgttagcggcgagttgagattttacccgatctttctccaaagcggtcaccttggcgtacatactcgcatctggcgagacgaaaatatcattcgggacaattcgggcgacaaataattcagcgttatttcttttagcaatttcaacagcttccataaaagctttattagccatatcggaaccgtcgacaccgacaaggattttttgatatgttgttgacatatgaaattaaatcagtttgcacggttaacaaccacttattcggaacaaataaaggccttacaacggattaagctccttgatgaaggttatgaagcattgtcagttcaagcgttagcacaacaaatattcgcacggttcttcccagaggcccactcaaaaacggctcaaaatgaacaaatgcaaaaaattcaggcgacggctagtttaaacttagccgattatttggcaggcatttcaacatcgtttgatcagcggacgttttataatattgcattgcagttgctagggtttaaggtgacaactgattttcaatttaatcaccctcggcgattcatggcaaaagtcgggataccctatgttgatcaaccggtattaacccaagaactctttttagaagctgtctacctcttattaacgacccgcagtcaaaacgggttgctttatttagattgtttggctaatcgtggtttctttgcgcattggcaaaaggcgaccgcacccgagttcttaatctttaatggtaaaacccaaccggtttttgatacgcaaaactttattcgtgaagtggtttatgttgaatcaagtttggataccgatttagatgggcatcttgacttgctcgaaacgacaatctttagacctaaggaaactgaaaaaggcctaagtgtaccggtcttatatactgccagtccttattacaaaggcactaatgatgtcgatgccgatctacacaacgttgatgtgcctattcaagctaaggcggccattcaaccaaatttggcggatttgaagactgggaccaatcaatctgtaccagctgctagagaaccactcggagaaacgactgaaacggaattagaagccgctgatgatagtaattacctgttaaatgattatttcttagcacgggggtttgcgacggtttatgctggcggtatcgggactcggggttcagatggcatgcggacgtgtggctcaccagaagaaacggcctctaccaccgcgattattgaatggttagcgggtaatcgtcgggcttatactaataaaacagatcggattgaaattaaggcttggtggtgcaatcaaaaagtcgccatgactgggaagtcttatttagggacgttggcgactgcggccgcgacaactggtgttgaaggattgaaaactgtgattgcggaagcggctatctccagttggtatgattactaccgtgaaaacggcttggtggtggcgcctgttgattgccaaggagaagatgcggatgttttagcgaaactctgtcaaactagacagatggacgcagcggatcatgctaaatcaggtgcgctctttgaagaacagttgtcggctttacgagaaggtcaagatcgaattacggggaattacaatgccttttgggccgaacgtaattatcgggacaatgttcaaaaaattaattgtgatgttgtcttggtacacggtttaaacgattggaacgttaaattgcaaaatgccggcgcactgtgggatgacttacggcaactaccaatcgaaaagaaactctttttacaccaaggacaacatatctatatgaataatatccaatcgattgattttacagatatgatgaacctatggttgagttatcagttgttagatatcgataatcatgcaccagaaatcttaccaacggtgacaattcaagataatacgcaagaagcgacttggcatacccaagatgattggttaaaccctaagaatccacgtcaaacttatttcttaaatgatccagaacatctagggttagatcagacgccaacgacgcctgtagcagatttcagcgatgatggtgttgccgtgtttaaaaaacagcatctcagtgaggctgcttggcaggatcaattattagcaccacaatctaactttacgcaaaatcgcttattattgttgtcaccggcgcaatcgaagcaattggtgattgatgggcgggtacagttgaaaacgaaagttgcggtcaataccgatcgtggtttgttgagtgttatgttggttgattacggtttatttagccgcttaggcacaacaccagctattttggccgctaaagggcaacaattaggttatcactggcgctacgatgatttgaaagaattcaaattaggcgcacttagtccttatcagttgatcactaagggccatctcaatttacagaatcgtcacaatagttatcaaaccgagacagtcgatgcaggtactttttatgaggtacaactagacttacaaccaacgcattaccatttagcagcgggccatcaattaggtttggtaatctatgcgactgatatggggatgaccttgcgggaagaacaacaaaatcaataccaagtggatctaggtgcgagtcgcttagtaattcctaccttggattaaatggcagaaacaatcacttgtcgccaaaccttatcaattagcaatcatcgagtgtttgcgagcgatttaaacgaacacgagacggtctatggtgggcgactattggaattactagatggcgcggcgtcaattgcggcgagccgcttagcccgtgttgaaaccgtgacggccagtattgaccaattaaattttattgcgccgtttaaattacaggattcgttgtgtatcgaaagttacgtcgttggtgttggtcaccgctcaattgaagtttttacaaaaattattggtgaacatctacaaactggggagcgtttcttaggtttgacggcttttttaacctttgtcacgacggaaaaaacgccgaacttaccagagattgcaccaacgacggcagaggaagaatttatctgtgcgggttatggtcaaagaaaagtacagcgcttggctaattttaaaaatcaacaagcctttaatcaacaaattaatctcgattatccatgggattattaaatgcaacaagtgaagcgttttttttcaaaagggtctaacattatgttgagtattcttttgttaattgtttttgtgtgtttagtgattacattgaagccacgcgatagtggggtgcagtcgatcaacttagatcgtgatcgattgcagtatcgtggcgcggttgaaaagggccgtttcagtggtgatggcaaactaatgttaaaaaatggcgactattataccggccaatttaaaaatggtcggtttgaaggcgctggtcaatttatttctcatgaaggttggcagtataaaggccaatttaaagcgggtgcaccttatggtaaaggtgaactgaagaaaaaccatgtgacttataagggggatctcgttaatgggaagtatcaagaaagcaagaattagatgggaagtatcaagaaagcaagaattagatggtttagtttaattcgcatttttggcctagggatggttttatactatcactattttaaaacaagatatgccggtggctttgttggggttgatgtgttttttaccttttcaggttacttaatcacagcactatttattgatgaatttatccggcgcgataaagtgaaactatgggcattttatcggcgtcggtttaaccggatttttccgccattattattaatggttctaatcgcggtgccgctgtctttaattgcgaatccggatttaagaacgaatttaacgaaacaaattaccgccactttaagttttacgacgaatttttatgaaattagtacgggtggtagctatgaaactaatttcattccgcacttatttgtgcatacttggtcattaacagttgaaatgcatttttatttaatttggggcttaattgtctatcttgtttcaagaactgtcaaaagtgcgaagtattttagaacggctgtcttcagtgtttcatttgttttatttgccgttagctttctatcaatgtttacgcaaattaaaggtttatctgaatattcaccgatttatttctcaagtttaacgcatggttatccattctttgtcggtgcgatgattgggagcttttgtggggttgggcaatcagcacaaggctttaatcaattaacgagtcacttgacctggaagacaccattaattggtttcgtggtcagtgcgttgttattatttggtttaggaacgcgtatgaagtttgatcaagctagtacgtatgcttatggcatcttactagggagtttaatcacaggatgtctcattatttttgcacgtctattgcatgataaagcacccaacgtggctgaaccacgcttcattacttatttagcggatattagctatgcaatgtatcttttccactggccattgtacattatctttttaagttactttaacaataatattaaagcagtagtggcggccttaattggctcggttattttctcaacactgtcttattattacatcgaaccgcttttgatgggcaaaccagttgcttaccaaaaggcggtcggtggtccgttattgtttgcgatggtaattttaggtgtggtgacagccaactatgcagttgacgcaccacatatgtcttctttggaacaacatctctgggtcggtaatctttatcaggacgctgatcaaattcaggcggttcacgctaaggttagtcaacccaaacaaacggtgccagttagccaaactaactataatgtgccccaaggcattagtattatcggtgacagtgtcacattaggcgcacggagttacttattagaacacgttaaaaatagtgacattaacgctgaaggtaaccgtcgaatggaccaggcgtatgacgtattgatgaatcaacaaaacaataatcaattgcgagaatatgtcgtgatctgtatcgggacgaatgcttttccagatttcaaagaacaaatcgataagattattcatgatttgaaaaaaggacatcgtctaatttttatgaccccttacgatggtcatgcggatgcgacttatgatagtaccaaaatcgcagtctatgaacggacgttaccagctaaatacccatttatcacggtgacggattggaataagattgctgctagccatccagaagtttttgaaggcactgatgggacgcatttcggtggcattgaaaaaggcaatattttatatactaagggcattaatgatgccattaagacggctggtaagaagaccggtaaagcataaatgtctttcaaaaaagtaatcacaagtgcaattgtaatgagtatggtagccgtttcagcactaaacacagtcgcagctaatgcagcaacagttgatgaaacacaagaagccattacaaataataaaagtgaaacagccaaattattaaaggatattgcaacagccaatgctgataatatcaaactacaacaacaaatcactgataacacaactaaaattgaaacgactaaaacaaatattgatcaatcaacacaaaaaatcgcaaccttaaaaacacaaatcacaagcgcaaaagctgaagttcaaaaaagaacgacagtgcttaaggcccaacttgttgcattacaaaaacaaacaggggacactgtcagtggcaatgtttactttgattttgtcttaaactcaaaagacttttctgatcttgttgcaagatcattcacagtcaataagttgaaccaagcaagtaaatcagcactagaagatgttaaagcagctaaagcagaatactcaaatttaatgacagaacaagaaacaactaaatctaatttacaatctgaaaaaacaagtcttgaagcacaacaaactgatttgaaggccatgaaggctaaatcagatcaacaacaagatgcattaaaccaaaaggttaatgacaataaggcaacattagaagcgctacaaacacaatatgatgaagctgcttctgctttaaaagttgctaacgatactaaggctaaagaaacaaaagtagtaaagactgctgtttctactaaagatacttcagataaagcagaagcaacaagtacttcaaatgatagcaaagcaagcacttcaagtaaaattgaaaataaaacaagcgacaatagtgaatcaaagaaatctaatgacgatagtgatagccaaggcgacggtagcacacatggtaacgttgctggcaactcatacgcatggggtcaatgtacttggtatgttaagcaagttgcaccttgggctggtaataactggggtaatggcggtcaatggggtgcttctgcatcagcagctggcttccgtgtcgatcatacaccatcagccggtgcaatcattgtctttgtacctggtcaatctgtaggtggtcaatggactgctgatcctacgtacggtcacgttgggtatgttcaatcagttagtggcagcagcgtcacaattacgcaaggcgggatgggttttgctaacgcggctggcccaaatactgcaacactttcagatggcggcagttacatgtatattcaccgttaagtggcgaaacgaaaattaatgatgattggcagtgttgtcatcatattaagtgtttttttagcgggtggctatgttgttaaagagcaaattgatcagaaagcagcccaacaagaaaaaatcgaaaaacaaacgcaacgacgaaaacgtcaaagtgaaaaagcggcgatggttaaatctgaaagtattcaaaaacaaaaagcgcgtgaaaaagaagcaactaagccaatgccaacggtggttgctgataatgcgttagatcaatattttaagcaagttaacttttcaggaacagcattaattgttaaagataacaaaattatgcttaataaagggtatggcacagctaatgaagcggccaaaaaattaaatacaccggacacgttatatccaattgcgtcaactgaaaaagcactgatcgcaaccggtattttacaattaaatcaacaaggcaagttgaaggttaccgatccagtggcgaaatatttaccccaatttcctaatggtcagcagattaaattgacggacttactgcatcatacttctggcattgttggacgtaatcaggacaatcaagaaaagaccagcgaccaattattagctgagattattgaaaatgggactaagggccaaccaggcagttggcactatttagatgctaactatattgttttggttaagattttagaaaaagtgagtcatcaaaactaccaagattacttacaaaataagattatcaaaccaagtaaaatgatgcatactgggtttatgtcagcgcaatacccacagttagcaaatgcctctatcgggtatgaaaccaaaggtggtgttaaaaaggctgaaatattaccgaactttagccagctttatggcgttggagatatgtatatgacggctatggatatgtaccgttttgataaggcactttggactcacaagttaattaaccagcagcaaaccgatttaatgtttaaaccgggtagtgattctcattatgggatgggcatgtataatgatccggcattaatcgtcaatcgcggctatctttctggttggagtgtttcaaacggatttagtcatggcggccgaatttatattgtattattctcgaatgttaagaacgataaaacgtcgttaagtaagatgaatagtgatttatacagtaaattagtggcaacaatataaatgactgaaaaatacattcttgcgattgatgaggggacgacaagtactcgctcaatcatttttaaccacgatggtcaaaaagtcgcggatgcacaacgtgagttcccgcagtactttcctgaacccggttgggtagagcataacgctaatgaaatttggaacgccgttttatcgactattgcaaacgcttttattaaatctggcattcaacctaaccagattgcggggattgggattactaatcaacgtgaaacgacggttatctgggacaaggcaactggcctaccaatttacaatgcggtggtttggcaatcgcggcaaaccaacgacattgctgaaaagcttaagacagatggttacgaagatttaatccataagaagacgggcttgattgttgatgcctatttctcagcaaccaagattcgctggattttagatcaagtgccaggtgcgcaagaacgtgctgaaaaaggcgaattgctctttgggacaattgatacttggattacttggaaattaaccggaggcgcaacgcacgtcactgattatactaatgccagtcggacgatgatttttaacattcacgacttggactgggacgacgacatcttgaagctgctcaacattccacgagcgatgttacctgatgtgcggccaaactctgaagtttatggtgaaacggcgccttatcatttttatggcagcagcgtaccaatttcagggatggccggtgatcaacaagctgccttgtttggtcaattagccttacaacccggaatggtcaagaatacttacgggacaggctcatttatcgtgatgaacactggtgaaaagccaacgatgtctgaaaataacttattaacgacaattggttattcaatcaatggtaaagtgaactacgctttggaaggctcagtctttgtcgctggttcggccattcaatggttgagagatagcatgcaattagttgagaaatcttcagattccgaagctgctgctaaagcttcaacgagtttaaatgaagtttacgttgtgccagcttttaccggcttaggtgcaccttattgggacgctgaagcacggggctcgattcttggtatcacgcgtgggacgaaccgtcaggatattattaaagcaacactgcaatcattagcttatcaaacacgtgacgttgttcaaaccatgcaaaaagatactgggattgatatcaagatgctacgtgtcgatgggggtgctgctaataacaactacctcatgcaattccaggcagatattttaaatagtgccattgaaaaagccgcaaacttagaaacgacggccatgggtgctgccttcttggccggcctagctgttggtttttggcaggatacagatgaattagcgcaaatcttctctgttgggcagcgtttcgaacctaacatgccagaagaagaacgtgaagatctatatgccggttggcaacaagccattgaagcaacaaaaattttcaaacatcgtccatataagatgaacgaataaatgacattttcattagaaagccgtcaacaagccattcaaaacttaaagaacgaacaacttgatttattaattattggtggtgggatcactggtgcaggggtcgccattcaatctgccgcatctggtattaaaacgggtttaatcgaaatgcaagattttgctgaagggacatcatcacgttcaacgaaattagtgcatggtgggattcgctacttgaagactttcgacgtcggggttgttgctgatactgttagcgaacgtgcggttgttcaaggtatcgcacctcacattccacggcctacaccaatgcttttaccgatttatgatgaacctgaagcaacttatgatatgttcagtgttaaaattgcgatggatttatacgataaattggcaggggttactgggacacaatatgccaactacacaattgatcgtaaagaagtgcttcaacgcgaacctggtttgaaatcagatcgtttgatgggtgctggtgtctatttggactttgtgaataacgatgcccgtttagtaatcgaaaatatcaaagaagctgacgaattaggcgcaacagttgccagccacgttaaagctgttgggatgacttatgatgctaatggccgcgttaatggcttgaaagcacatgatgaattaacagatgaaacattcgatattcatgccaaattagtgattaatacagctggcccttgggttgataaagttaacgctttgaatactgaagtgaaagcgcaagaaacacttcgtccaactaaaggaattcatttagttgttgatagcagtcgcttatcagtgccacaaccaacttattttgattcaggtctccatgatggtcgcatgattttcgttgtgccacgcgaaggcaagacatacttcggaacaacggatacagattatacaggtgactataaacacccacgtgttgaacaaaccgacgttgattacttattaaaggctatcaataaccgttatcctagcgttgatatcgcattaaacgatattgaagcaagctgggctggtttacgaccattaatctcaaacaacggtagttctgattataatggcggtggtgctaatagtggtaaggtttcagaagaatcattcaataacctaattaagactgttgatgactatgaaaataaaacagctgctcgtgctgatgttgaaaaagcaatcagccaattaagaacagcccatgctgaagaaacggttaacccttcacaagtctcacgtgggagttcacttaaagtggctgaaaacggcttgatgactttatcaggtggtaagattacggattaccgtaagatggctgctggcgcattagaaatgattcgtgatatcttgaagaaagacttcaacgaaacggttcgtgaaatcgattctaagaagttacaagtatcaggtggtcattttgatcctaataacgttgaagaaacattgaagttctacacgaaagtagcgatgagtaagggtatttcagaagatgatgccactgacttagctaatcgctttggttcaaacgttagccgtgtagtttcatatgcagatcaaggcacagctgaaggtttgaacttgaaggaaacgattagtttgagatattcagttaacgaagaaatgacgttaacaccagttgattatttattacgtcggacaaacttcgtcttattccacaatgatcaattggcagccatcaaacaaccagttatcaacgaaatggcccgtctcttgaactgggatgctgctgaaaaagaacgtcaaacagcacaattagatgccgcaattgctgaagcacaactcgactatttaaaatagatggataattcaataatggtccaagcactaggcgaattagtcggtacatttatcttagtcctcttaggggacggggtcgtggccggtgttagtttagcaaagactaaggccaacggtgctggttggattgcaattacgttaggttgggggtttgccgtaacgctaggtgtttacgcatcagcatttatgggtcctgcccatttaaacccagcggtcacgctcgcctttgcaatcatcggtaaagtatcatggtctgttgtattaccatttatcattgcccaaatgattggggctttcttgggggcagtcgttgtctggattcaatactacccacattggcaagcgacagatgaccaatcagcgattttagggacttttgcaaccggtcctgcaattagaagcccatttgccaacttaatgagtgaaattattgggacatttgtcttagtattcgcattgttagcattgacacggggccaatttacagaaggcttaaacccacttgtagttggtgttatcattactgcaatcgggttatcacttggtggaacaactgggtatgcaattaatccggctcgggatctaggcccacggattgcacatgcagttctaccaattgccaacaagggtgattctgactggcaatacagttggattccagttatcggcccattcgttggtgggattttaggggcattattgtttgtcctgttaccataaatgactgatgtagcgattgtgatgggatcgatctctgattgggaaacaatgcaggaaacggctcagattttaacggatttgaatgtgagttataccaaaaaagtcatttcggcacaccggatgccaattgaaatgattgcttttgcgcaaagtgcggcggaagaaggttatcaagtgattattgcaggtgccggtggtgcagcacatctaccggggatgttggctgctaacactgttctgccagttatcggggtaccaattcaaagcaaggcgctcaatgggatggactcattgttgtcaattgtccagatgccaagtggtgtgccggtggcaacggtagcgattggtaaggcaggcgcaattaacgctggtttgttggcaacccaaatctgcgggcttaaaacaccaacttatcaaaaggcattagtgcaatacaaacaagcacttcatcaaaaggcggtggcaagtaatgaccaacttaactaaatgaccaacttaactaaacaaattttaccaggacaagtcattgggattattggtggcggtcaattaggacagatgatgaccttggccgctaagtcgatgggctttaaagtcatcgttcttgatccgcaagttgattgtccggccggtcaagtggctgatgaccaaattgttgcggcttacgatgacgagaatcaaatcattgaattggcgaaacgttcggatgtcgtgacctatgaatttgaaaacgttgatgcaacgacgattgaaaaagcacaacaattaacacaaattccacaaggaaccaaggcgttacggattgcacaagaccgtgttttggaaaaacaattcttagcaaccgagaaattaccgcacgccgcttttaaagtcgtaacatcgattagtgaattaactaaagcggtcgctgagattggcttaccctgtctcttgaaaacggcccggggtgggtacgacggtaaagggcaacttgtcttaagacgggccagtgatattgaagccgctagagcacttctggattttggcgtttgtgtgttagaagaaatggtgacttttgatcaagagatttcagtcatgattagccagaattgggcagggcaacaggcactttttccagtcattgaaaaccaacaccggcataacatattacatattagtatttgccctgcacgggtaccggcggcggttgcacaagaagctaagaaaattgcccagaaaattgcgacggaaatagaattggtgggaacactcggggtagagttcttcgtgacgccaactggccagttgtttgtaaatgaaatcgcaccaagaccgcataattcgggtcatttaacgattgaagcttgtgacgtgtcgcaatttatggcgcacattcggggggtttgcaattggccacttcaaacgccgcgtctttggcaatcagctgtaatggtcaatgtcttgggccaagatgtaccaggtgcactggctaagagctgccagtcaactgattggtcttatcacgattacggtaaggctgagcgcaaagaaaatcggaagatggggcatatcaccctgttgactgatgatctaaacaaaacactttctgaaattgaagcaacacaaatttgggcattaccaaaggagcagacaaaatgaatgattgaacgttatacaaatcctgaaatgggtgccatttggaccgatcacaacaagtatgaagcatggttagcagttgaaattttagcggatgaggcgtggtctaaattagggcatattccggcagaagatgtcgctaagattaaagccaacgcgcaattttcaattccttgcattctagaaattgaacaggaaacaagacatgatgtggtggcgttcacccgggccgtttcggaatcactaggtgctgaacgaaaatgggttcattatgggttaacgtctactgatgtcgttgatacggcttacggctatttattgaaacaagcgaacgccattttacgagctgatatcgacgctttgatagaagtgattggtaagcaagctaaacgttatcaagatacagttatgatggggcggacacatggtgtgcacgctgaaccaacaacttttggcttgaaactggcactttggtattccgaattaaaacgccataaagaacgatttgaaacagctgctgaaggtgttgaagcaggcaaaattagcggggctgtggggaccttcgccaatattccaccgtttgttgaaagctatgtttgtaatcaattggggattcgggctcaagaaatttcaactcaagtcctaccgagagacttacacgctgcttacgttgctgaaatggcgttgttagcgacatctatcgagaaattcgcgactgaaattcgtggtttacaaaaatcagaaacgcgcgaagtggaagaatactttgctaaagggcaaaaaggctcttcagcaatgccccataaacgcaatccaattggttctgaaaatatcacaggcttaacgcgggttattcgcggtcatatggtaacggcttatgaagacgtagcgctgtggcatgaacgcgatatttcacatagctccgctgaacggattattttaccggatacaaccattttattagattacattctcaaacggtttacaaaaattatgacgaacttgacggtcttcccagaaaatatgaaacgtaatatgggtcggacttttggtttgatttatagccaacgcgtgttattgaaattgatcgatcacggcctttcaagagaagcggcctatgatttgattcaacctaagacggcccgttcttgggatgaacaaattgatttcagaccgttattagaagccgacgaacaggtaatgagcattctaacgccagctgatttggatgatgcgtttgactatcattatcatattcggcatgtggccgaaatttttgagcgtgttggtttgggttaaatgagtgaaacgttactttattcagggaaagccaaggacttattctcaactgacgaccccgaagtcttaaaaatgatttataaggatcaagcaactgctttaaatggtaagcggaaagaacagattactggcaaaggggaagttaattatgaaatttcaaaattaatttttgcttacttaagtcaacaagggatcgaaacccatttaatcaaaaatgtatctgaaaccgaacaactcgtcaaaaaagtcaccattatcccgttggaagtggtcttgagaaatgtggtcgccggaagctttgcacggaagtttggtcaaccactgggccaacgattagaacaaccgattattgaatattattacaaaaatgatgctttggacgatccggctattaatatctcgcaagcaacggctttgaaactggtgacacctacggaagtggctacaattgaagccatgacgaaacagattaatactttgttgattaagttattcaatgaaattggcattgatttaattgatttcaaattggaatttggtcgctatcaaggacgcttaattttagcggatgaattttcaccagataattgtcggctttgggatcagaaaacacactcatcattagataaggatgttttccgccagaataagggcgacttagtgacagtctacgagacggttttacaacgcttaacaaaaatgattggaggttcaacaaatgtataaatgtataacgtgcaagtttatgtcacctataaagattcagttctagatccacaagctcaagcggttcaaggtgcgattcaacgcttaggttttgaaggaatcagtcaaatgcgaattggtaagtttttcgaaatgcaagtgattggtacggatcaagccgctgtgattgagaaagttgaagcgatttgcgatcgactattggctaatccaaatatggaacaataccgctacgacgtacaattggtggaggacgcaaaatgaatgaaattcgcagtgcttgtttttccaggatcgaattgtgatgccgatttataccacgcaattgtcgatgtctgccatgaagaagcggcttatgtctcttacacagcaactagcttagccggttttgatgcggtgctaattccaggcgggttttcatacggcgattatttacgcagtggcgcgattgctaaattggcaccaattatgacggcggtgatagcttttgctaaagcgggcaaaccggttttaggaatctgcaacggtttccagattttgacggaagcaggcttattaccaggagcgctgttgcccaatcgccaaacgcatttcatttgcgaaacggtaactttacaggttgaaaatagcgatacatgctttacaaatcaatatgcaaaaaggaccacagttgcgctaccgattgcccatggtgaaggtaattattattgtgattcagaaacgttggcccaattgcacgccaaccaccaaatcgcatttacttatacaaccgacgttaatggtagtttagacaatatcgcgggtattacgaatgaagcggggaatgttttagggatgatgccacaccctgaacgtgcagtcgaagccttattgggcagtgcggatgggctgggtgtcttccaatcaattttgacaattttgaaaagcggggtagtaactcatggtgaataaatggtgaataatccaacggcaactgagattcaacaaaccaagttataccaacaatggggcttaaccgatagtgaatacgaattgatttgcactaaaatcttaaaacgattgccaaattacacagagacgggccttttctcggttatgtggagtgaacattgttcgtataaaaactccaaaccgatccttaaaaaatttccaacgaatggccctcacgtgttacaaggaccaggtgagggggccggtattttagatatcggcgatgggcaagctgttgttttcaaggctgaaagtcataatcatccctctgctgttgaaccttatgaaggggcagctactggtgtcggtgggattatccgcgacattttttcaatgggtgcaacgccgattgccattttagacagcttgcggtttggggagctcaatgataaccaaaccaagtatctggtccaggaagtggtcgctgggattggcggttatggtaattgtattgggattccaacagtcggcggtgaaatcagttttgatccgtgctatcaagccaatccattggtgaatgcgatgtgtgtcggtttgattgaacaaaaggatattcaacaaggaaaagcgcgaggagccggcaatagcgtgttgtacgttggcgccaaaaccggacgtgatggcattcacggggccacctttgcatcagacgaatttgcagaagggaaagcaacgcaacgctcagccgttcaagtcggcgatccattcatggaaaaattattgatggatgcttgcttagaattaattttgcaacattcagattggttggtcgggattcaagatatgggggcagctggattggtttcatcaactgctgaaatggcggctaaagcgggaaccgggatgattttagaccttgatcaagtgccgcaacgcgaaaccgacatgtctgcttatgaaatcatgttatctgaatcgcaagaacgaatggctttatgtgttagagctggctatgaagaccaagtgattgctttatttaaaggctacgacttagatgccgttcggattggggaagtaacaaccaaagaacaataccaactatggcatcaaggccaattggttgctgatttaccagtggcggccttaacggatgccgcaccggtttatcataaggaccaagcaaaaccagaacgcttagcaacctttgccgctcaagtgccttatgtgcctagcgtgacggacacacaggcaacttggttggcactattaaaacaaccaacaatcgcggataaaagttcattctaccgccactatgatgcccaagtgaaaaccaataccgtcgttttacctggtagtgatgcagccgtagtgcgcattcgtggcaccaaaaaggcccttgcaatgacgactgactgtaacggtcgctatctttatctagatccccacgtgggtggccaaattgcggttgttgaagctgctcgaaatattgtcgctgctggtgggcaaccattagggattacggattgtttaaactacggtaatccggaaaaaccagctgttttctgggaatttgatcagagtgctcagggaattgctgctgcttgtgagacttttggcacaccagtgatttcggggaatgtctcactgtataacgaatttaacggagaagcgatttaccccacaccaatgattgggatggtcggtttaattcgggacaccgcagatgttaccacgcaagattttaaacaagccgatgatttaatttatttgattggtgaaactgacgataactatgcaggtagtgaattacaaaagatgcaacaaggtactatttcaggtcaactgggccatttctcattagcaacggaaaaggctaatcaagatcttgttttaaaagccattcaacaaggcttgattactagcgcgcatgatctatcagaagggggcttagcggtcgcgctttctgaagcaaccttcaaacaaggtttggggtatcacgtacaagtagatttagctagtcgtcaattatttgccgaaacacaatcacggtttattgtgacggttaaagtggctgatcaagctgcttttgaacagattagcgaccagtcagcccaattgattggtcgggtaacggctgaaccaataatgcatattcaaacgaaagatgaaacgattgacttgaccgttgaagcggccaaggatgcttgggaggcggctttaccatgcttaatgaaatcagaagcttaaatgcttaatgaaatcagaagcttaaatgaagaatgtggtgtctttggggtttggggccatccagatgccaaccaattggcctattttggccttcatagtctccaacaccgggggcaagaaggggcgggaatcgtcacgaatgacaacggtcagttactaggttatcgcgatcgcggtctattagccgatgtttttcggaacccagaaaatttagcccaattaacaggtgaagcggctatcggtcatgttcgatacgcaacggcggggagtcacggtttagaaaatattcaacccttcttgtttgattttgccgatggtcaatttgcgttagcgcataacggcaatttaaccaacgcggtcacgttacggcgtcaattggaagatgagggtgccattttaaagtctagttctgattcagaaattttaatgcatctcattcggcgagcggctggtccggatttgcacactaaggttaaaacagccctcaaccaaattcacggtggttttgcctatgtgctattaacgcaggattctttgattgcgatgcttgatcctaatggcttccggccattatcgattgggcaaatggccaatggggcgtatgttgttgccagtgaaacgtgtgcgctgaatgcggtcgaagcgacttttattcgggacgtacaacctggtgaagtcgtgacaattgatcgcgatggcttacattcggatttcttcacgaccgaaacgacccattcgatttgctcgatggaatatatctatttcgcacgaccagattctgatatttgcgggattaacgtccacgcagcgcggaagcgaatgggtaaacggttggcggcggaaacgggcgttgatgccgatatggtaatcggggtacctaattcatcgctctccgcagccagtggttacgcggaagccagcggcctaccatatgaaatggggctcgttaaaaatcaatacgtcggtcggacctttattcaaccgacacaagcactgcgagagcagggtgttaaccgcaagttagcagttgttaaaagtgtcgtggcaggtaaacgaattgtgttagttgatgattcgattgttcgtgggactactagcaaacacattgttaaacggttgaaggaagctggggcgctagaagtgcatttacgtgtcgcctcaccaccattaaaatatccttgtttctacggcattgacattcaaactcgcgaagaattaatcgcttcacaacaaagtgtggctcaaatgtgtgaaacaatcggtgctgattcattggcctttttgagtcaagaaggtttgattgatgcgattggcttacaccaagatgcgccgtattcagggttatgtatggcgtattttaacggcgattatccaacaccgctatacgattatgaagcagattatcaagcgagtctaaaacaagataaggagtaaatgacagatgcttaccaaaaagcgggcgtcgatgtgacggctggttacgaagtcgttgcccgcatccaaaaaaaagtaggggctgataatcacaatattggcagctttggcggacaatacgcgctagaaatggcccagtatcaaaaaccggtgttagtctcgagtacggatggtgtcggtacgaaattgatggttgcttttgcagctgatcaacatgcgactatcgggattgattgtgtggcgatgtgtgttaacgacattgttgcgcaaggtgcgcaaccgttatacttcttagactatttagcaactggtaaaactgatccggataagattgaagacatcgtcgctggtgtgctcgaaggttgcaagcaagccaatatggctttaattggcggtgaaacggcagaaatgcctggtatgtatgcggataagcactatgacgttgccggttttgcagttgggattgctgaacaagatgcgctagtgaccggtaaaacgattcaggctggcgacgttctgattggattagcgtctagtggtcttcactctaatggttattcattggttcgcaaaatcttttttgagcaaaataatttgacagttgctagtcaattgccagagttaccgggtaagacactgggtgattggttattaacacctactaagatttacgttgaagacttacagccgctactgcaacaacgggtgattaaaggcgccgcacatattacgggtggtggttttattgaaaacgtaccgcggatgttaccgactgatttggcggctcacttaacgttgggcagctggccaatcttaccgatttttaaggtcttacaacaatatggtcaacttgctgagatggaaatgtataacatctttaatatggggattggaatggtcttggcggttgcaccagaagcagcaccagccgttttagcacaattgaatgctaaacaggaacaagcttatcagattgggaccgttcaaaaacgtcaacaagcggcggttgaattggtgacagccaaatgaatgagagtggcaatttttgcatctggcacagggagtaacttcgaagcaattgctgataatcaacgcttacaacaagcgggccttgaaattgtccaattggtttgcgatcgcccgcaagcagccgtgattgaaaaggcgcaccggcgggaggtgccggtgactgtattggcaccacgtcagtttgaaaatcgtcaagcttacgagcaagcagtcgttgcccagttggcgcctttggcgatcgattatattatcttggcgggctacatgcgaattatcacgcccgttttactaggcacttatcctcagcggattattaatatccacccggcattgttaccggattttccggggattcatgggattgaagatgcgtaccgtgccaaggtgagtgaaaccggcgtgacggtccactatatcgatgaaggggtggatacagggccaattatcgcccaagcaaccgtcccggtgaaaccaaatgatacgttagcaacgctagaagcgcgtgttcacgcggttgaacatcaattatatccagctgtgatttatgatttaattcaaaaaaataattaaatgaaaagagcattgattagcgtttcagacaaaacgggtattgtggcatttgcccaaggattagtagcggcagattttgaaattatttcaactggcggcacttttagcgtcttggaaaaagcgggtgtaccagtgacacccatcgatgaagtgactcattttcctgaaatgttagacggtcgggttaaaactctccatcccaatattcacggtggcttattggctaagcgcgatgaaccaacgcatatggcagcacttgctgaacacgagattacaccgattgatctggtttgtgttaacctctatccctttaaagaaacgattcaaaaaccagagattacccaagcgcaagcgattgaacaaattgatattggtggcccatcgatgttgcgttcagctgctaaaaactttaagtcagtgtacgtcgtggtagatcaagccgactatgacgaaacattggcacaattgcaacaagatgatgtcacttaccgccaccatttagccgctaaagcattccggcacaccgccgcctatgatagtttgattgccggttatctgtcagatgctgatgcggttgaattccctgaaaaactttccttaacatacgacttcaaacaagcgttacgttacggcgaaaacgctcatcaaaaagctgccttttaccaaagtgctttaccaagcgccttttcgattgctgctgcccatcaattacacggaaaagaattgtcttacaacaatattaaggatgcagatgcagcgattaaagtggctgcggaattcagcgaaccatgcgtggtggcgatgaaacacatgaatccttgtggcgttggtttggggacaaccatctacgatgcttggcaaaaagcttttgcagctgattccgtctcaatttttggcggcatcattgccttgaaccgcgaagtagacgttcaaacagccaatgctttgcatgaattattcttggaaattgtcattgccccaagttttgcgccagaagcgttagcaattcttgaaaagaaaaagaatattcgtttgatgacacttgattttgaacaagccgctaaagcggatcgtttcgaaacagtttcggtcttaggtggtctattggttcaagaaagagatcgcttaacggatcaagcatctgaattgaagacggtcaccactaaagccccaactgaagatgaaaaagaagcgctcctatttgcgcaacgcgtggtaaaacacgtcaagagtaacgcgattgttgtcgcaactaaagatcaaacgttgggcgttggtgctggtcagatgaaccgggttggctccgttaaaattgcgttggaacaagcattagctaatgggatgcaagcaccattcgtgttagcatcagatgcctttttcccaatggacgatagcgtagcctacgctgctgaacacggcattacagcgattattcaacctggtggatcaattaaagatcaagattcaatcgacatggcgaaccaaaaaggggtcagcatggtctttacaaatcgacgtcattttaaacattaaatggatatcttggtgattggcagtggtgcgcgtgagcatacactggcacgagaactactaaaaagtgaacaagttgaacaggtctattgcttacctgggaacccggggatgcaattggaccggataaaaacggccgcaattgacgtcaatgattttgagcagttaattgcgtttgctaaaaaacaggcggtggcttacaccatcgttggcccagaacaaccattagtcgctgggattgtggatgcttttcaagccgcggggttagcaatttttggcccgacgaagcaggctgcggcattggagggctcaaaaacttttgccaaagaaatgatggctcgagcacaggtgcccaccgcccaatatcaaacggtaactaatgaatcagaggcgttaaccgccttgcaagggcgttcgttgccaatagtgattaaggccgatggtttagcggctggtaaaggggtggtcatcgctgaaacattagcggatggcttagcggccgttcgacggttcttcaaacaagggcgtcgtcagatcctcatcgaagactatttggtcggtgaagaattctcgctaatggcgctagtagccgatgaccaagtttatccgctgccaattgcccaggatcataagcgggcctttgaaagcgacaagggacccaataccggtgggatgggcgcctattgtccagtaccgcaaattagtgatcaaatggtacaaacagcggttgaaacgattatcaaaccagttgtggcaacgatggccgctaatggcacaccgtttaccggcgttttatatgcggggttaattgcaaccgcaactgggatcaaagtaattgagttcaacgtacgctttggcgatccggaaacccaagtggtgctaccacgtttgcaaggtgatttagcgcaagtctttcagcaattgttaacgcatcagcaaccaacattggactggcaaacagacggtgtgacgttgggggttgtggtggccgctaaaggttatccaagccaagcaccagcaattttccagttggcaccaactgctcgttttaaagcggctaatagtcagtttagctttgccggtgtggcaccaacaaccgggggcttaatgagtgctggtggccgtttatatacggccgtttatacggcacccacaatggcgcaagcgcgagtccaaattgaagctgacttacaatcggtggctaatccacaaagctttttccgccgagacattggttttaaaagtcaaatgtaaatgacatatcatacaagtgacgcagaacacccaattgatatcttaaacctagcatcgctagagggtcgtgtgaaggaacggatggaagccggtgctttcggctatattcgtggcggttcagaagatgaatggacaatggctgaaaataccagtgccttcaatcaaaagaagattatgccccgtgttttacaaggggttgaacacgctgatttgcatacaaaattgtgggatattgatttgaagacgccgattattcaagccccttcagccgcacaaggcttagcccacgaaaagggtgaagtggatactgccaaagggatggccgcagctggttcaatcttctcaattagtacgtatgctaatacactcgttgaagatgcagccgcagcagcacctgatgcaccacaattcttccaactttatatgagtaaagacgatcaatttaatgaattcttactacaaaaggccgttaaagccggtgttaaaggcattattttgacggttgattcaacgttaggtggttatcgtgaaacggatatcgaaacaaaattccaattcccactaccaatgcctaacttagcagcttatagtaactcagatggtgctggcaaaggcatttcagaaatctatgctgctgctaaacaagggattgttccagaagatattcaaaagattaaagaaatcacgcacttacccgtcattgtcaaagggattcaatcacccgttgatgctgagttggccgttcaagctggcgctgatggcatctgggtatcaaatcatggcggtcgtcaattagacggtgggcctgcttcttttgaagtgttaccattagtggcgcaacaagttgctaaacgggtgccaatcatctttgatagtggtgttcgtcgtggtgaacacgtctttaaagcgctcgctagcggggctgatttggtcgcgattggtcgcccaattatctatggcttgaacttaggtggcgcacaaggtgtcacctctgtgattgatcatttgaaccatgaattgtcaattacaatgcaattagctggtaccaagacaatcgatgccgttaaagaaacaacattgcttgattaagtgttaatagaaagcgtggtgtggattatgaataaaatgggcgtgtttatgagtttggttgtgacgtttgtggtcggagtggttgttggctggcaagttttaggaactaaggcagtgacgcaagaaaaattgccaacgacgaccgaaacatcgcaaagtcgccaaaccaataacatacaacctgatcaaaatagtgatgaaggcccaacggaaaatcagccgcaaacaagtgaaagtcaatcaacggcggatgcaacaacagtttaattaatgccggttgacagtcggtaagtccgctaagaatagttcgcttgcgactaagccgattaaacttaaaataaagtaaatccagtgggcaccgctcccccaaccaaagaggctagcgtcaatgccgactaaaataatgaaaataagacaattaagcactagtccgattcgaaatgttaattggctagcaactacagcgaataatacgattgaaagaaaaatagtaaagaatgcagaaatcaaatggttcgtgaaagtaatcctgaaacgaccgacccacgtgttcagcgaacaaagcaacaattgcgccgagcactagttgaactattaaaaacagcaaccactaaagaaatttcaattcaagcaattactaaacaagcacagattacccgggggactttttacctccattatgaagataaaacggattttattcaaaaagcagtacaagatttaattcgggatttataccaaacagtgacaatccaaaatgataagatggcgcaaccctatcagcaaatcaatttattagcgttatttgaatatgttgaacgccgccaagatgcctttaaagtattccataaaaatgatacgagtttggcttttaaacagcaattaacgaccgaaatgcggcggctaattgaagcctatctcaataatttatttcaagaggcaacccagtctgatcagattgaattgagtatcacagcagattatcttgctggtgcgagtttagtgctcgttttcaagtggattgaagatggtttagtctattcaccacgctacatggctaagatgctttatcaacttgttcagatgccaaacatggcttttaatgtggctggattcttcgttgaagcgtaaatgtacgcaattatcaaaacaggtggcaaacaatataaggtagaagctggtcaagcaatctacgttgaaaagttagccgcagaagctggcgaaaaagtaacttttgatcaagttattttagttggtggtgaaacaactaaggttggtacaccaaacattgatggtgttactgttgatggtactgttgaaaaacaagggcgcgaaaagaaagttgttactttcaaatacaaacctaagaaacacagtcatcaaaagaagggtcatcgtcaaccatatactaaagtgatgatcgacgctatcaacgcttaaatgattaaggctgactttatcgtcaatgcggattcgcaaattatttcttttcaaattacgggtcatgctgactcgggtccttacgggagtgatatcgtttgtgcagctgtttcagccgtctcaattgggacgattaacagtttgcaaaagctcgctggttttgaaccagaggtagaagcagataacctaaatggtggtttgttaacctgtcaagtgccggcaacggttacgggacaagctttggcaacggcgcaaattctcttgcagaatttgcaactgacgctcgaagatattacgcaacaatacgggcagtacattcaagtacaaacaaaacgtaaatagatgttacaaatgaatttacaattcttctctcaccataagggtggcggttcaacaactaacggccgtaactctgcaggtcgtcgtttaggttctaaacgtgctgatggccaaactgttacagctggttcaatcctttaccgtcaacgcggtacaaagattcacccaggtgaaaatgttggtcgcggtggcgatgacacattatttgctcttgtcgaaggtgtcgttcgtttcgaacgtttcggtaaaaacaagaagaaagtttctgtttatacagcagaagctaaataaatgttatcagttaacgattttaaaaacggcttaacaatcgaatttgacaacaacctatggcgagtggttgaattccaacatgttaaacctggtaagggtggcgcttttgtccgctcaaaacttaagaatttaagaaccggcgctaaccaagaaaaaacattccgttcaactgaaaaagttgaaagagcaatcattgatacaaaatcaatgcaatatctttatgcagatggtgacaatcacgtcttcatggatacagatacttatgaacaattagaattaccagcagcacaaattcaagatgaattaaaattcttgaaggaaaacatgcaagtttcaatcatgatgtttgggagcgaaaccttaggggttgaactacctaagacagttgatttggcagttgctgcaacagaacctggtgtgcgtggcgatacatcttcgggtggtacaaaaccagcaacactagaaacaggcttagtggttcaagtaccattcttcattaacgaaggtgatgtattaacaattaatacgtcagatagtacttacatttcgcgtgcctaaatggctgaagaaacaaatattgtactagatacgcaagaaaattcattgggtaagatccaaatggcacctgaagtggtggaagtcattttaggcattgccgcaagccaaattgaaggcgttcatcagatgcgtgggacaatctcatcatcgattaatgaattatttggtcgttcaaatcatggtaagggcgttactttaaaagtgattgatggcaaagttaatgcggacgtttatgtctaccttaattatggcgtttctgtccctaaggtggcccttgccatgcaagaagccttgaaggaacagttattatttatgactgacttagaattagcggaagtcaacgtacatgttgttggcgtcgtaaccgaaaaaacacaaaatattattgatccagatgatttatttaacgatgaaacacctgatctaaatggagaccaatcttaaatgcctaattttaatcgacaccaaattcgacaagcagctttccaagtgctatttacactcaatgcgaatcaatctttagaattagaggatgcttatcaagccgtcttaacgatggatcaatttgatgctgaagaagtgacaccagttgaagtgcctgcttacttggctttcttagtatcaggtgtaactgaaaatcaagccgctcttgatgcagcattaaccccttatttgaaaaaaggttggcaactttctcggttggcaaaaccagaccttattattttacgattaggtttgtttgaaatgcaaaactcaaccgaagcacctgctaaagtcgctttgaatgaagcacttgaacttgcaaaacaatttacagatgatcaagcaaaaggcttcatcaacggcgttttatctaaattcgttgaagcttagttggaattactagacggtagagcacttgcaaatgaattgacacacgcacaacaaacagcggttgaaacacttaaagaacaaggtgtaacgcctaagttagtggtcatcatggtcggtgatgatccagcgagtgcgatttatacgcaaagtaagcaaaaaagagcaaccaaaattggaatggcttcagaattgaagcgtctatcagctgaaacgaccgaagctgaattgttggccttggtaaaaacgctgaatgacgatcgcaccgttgatggtattttggtgcaattgccattgccaaaacaaattaatgaagatcatgtcatccaagcaatcgatgccaaaaaagacgttgatggttttagtcccgttaatattgggcaattatggctcaaccaaccaggattagtggcctgcacccctaatgggattatgcgcttattagcggcccacaagattgatgtggctggtaaaaacgttgtgattgtcggtcggagtaatattgtcggccgacctttagcagcgttgatgctcaatgctaacgcaaccgtaacgattgcccatagtcgaacagcaaatctaaaagccttaactaaaacggccgatattttggtagcagccattggtaaaccacactttttcggaattgatgctgtcaaagaaggggcagttgtcatcgatgtcgggattaaccgccttgaagatggctctgttactggcgacgttgatttcgaagcccttcaaaatcacgtcagcgcaatgacgccagtgccacgaggtgtcggcccaatgacgattacgatgttaatggaacaaacgattgaaattgcaaaggaacgtgtcaaacgtggttaagtggttaaaccaactgattatttaacagtcaccgctttaacgcaatatttgaaagctaaatttgaacgcgatccgtatttggatcgggtttatttgactggtgaaatttccaacttccgcttgcggcccaatgcgcatcaatattttagtttgaaggataataaagctaaaattagtgccattatgtttaagtcggcctttgaaaaggtgaagttcacgccggaagaggggatgaaagtcctagttgtcggccggatttcactatacgaagcttccggtaattatcagatttacgttgaacgcatggaacccgatggccttggggcgctataccaagcctacgagcaattaaaggcgaaattagcaaccgaaggcttattcgatgcccctaagcaacctttagtccgtttccctaaaagaattgcggtcattactagtccttccggggcagtgattcgcgacattattacgactacccaacgacgctatccaattgcacagttagtgttgttcccagcagttgttcaaggtgacggtgcggctgatgttttagttgagcgacttaaacaggttaatgaacacggcgactttgatacgattattatcggtcggggtggtggctcgattgaagatctatggccgtttaatgaagaacgtgttgcacgggcgattgtggccagtcagattccggtcatctcatcagtgggtcatgaaaccgatacgacgattgctgatttggtcgcagatgttcgagcagccacaccaactgcagcagccgaattagcaacccccgttttaacggatgaaattttaaaattacaacaacagcgtttacggttatatcaagccttttcaaaaaacgttgcgcttaataaaaaacaactcgatcatttacaaaatagttatgtcttgaaacagcctaaacgtttgtatgatggctatctccaaaatgttgaccaactacaacgacgcttattgactgcacaacagcaactcttaaaggaccggcgccaacaggttcaattgttgcaacaacggttatcggcacaatcaccactgatggcggtgcaacaagcgcaaaaagacgttactgaacaacaacgacgtttaaaccaagcgatgaaccgcttaatggttgatcgccggcaaaaggcagcacaagtcattgcagcactcgatttagtcagtccgttgaagattttaggccgcgggttcgcctatgtcacggatgatcagcaacaaatgttgaaaaaagtggcagattttaaggcccaacaaccgattgaattacacgttcaagatgggttagtaacagctgaagttgtcgcaacccataaaggagaagaataaatggcagaaaaaaaattaacgtttgaagaaaatttagcgcaattagaagtgattgttaatgagttggaaacgggcgatgtcccgcttgaaaaagcaatgacggcctttcaagaaggtgtcaaactcagtcaaacacttgaagaaacattgagccaagctgaaaagacaatggctaaagtaatggccgataacggcgaagaagtgccattagatgctgaggagcaacagtaaatggctgattttaaacaattagcggcacgtgaattaccgcagtttgacgcttatttaaaacgtgaattagcgaaaattcaagaaccaactttacaaaaatcgatgacgtactcggtcatggcaggtggtaaacgattacggccacttttgttatttgcagtcttggaaagtaccggtcaaagcattgatgagacagcttttagagcagcgggtgcgcttgaattaatccatagttactcgttaatccacgatgatttacctgcaatggacaacgatgatttacggcgcggccaaccgacgaaccataaggtctttggtgaagctgaggctattttggctggtgatgggttattaacacttgcgtttgagtggttagcgaccttaaacgtgaccgcagaacaacgaatcgaacttgttcggttgttagcgcaagcggccggtgccaacgggatggttgcggggcaagtcgaagacattgaaggcgagcacaaagcgttgacattagcgcagttgcaacaagttcatcatcttaaaacaggttgtttaattgaagtcgcggtggccatgggcgctgtcttagcgcaacttggtgaggttgaaacaactgctttacgcggttttgcgcaacaatttggtttggcctttcagattcaagatgatatcttagatatcaccagtaccactgcggaaatgggcaaagctgttcataaagatgccgcagaacaaaagaataccttccccattttattggggttgtccggtgcgcaagaagcacttcacacgacttgccaacaagcacaacaacaactggcgcaagtcacgacttttgaccggactttattaaatagttttttggactatttcaacgaatagatgaaaaaagaacgggtagacgtactattagtacaacaaggtttatttgaatcacgggaacaaggcaagcgggcaattatggctggtgaagtttatgggaaaaatgatgaacgaattgacaagcccggcgaaaaaatcgacgccgaaaccgtattaagagttaaagggcacaaaatcccatacgtgggtcgcggtgctttgaaattggcgaaggccatcgatgtttttgatatcgatcttaaagataaattaacgctggatatcggttcatcaacaggtgggttcaccgatgttgcgttgcgtaatggcgcacggcgctgttatgcgcttgatgtgggttataatcagttggcttggaagttgcgtgaagatccccgcgtagttgttatggaacgggttaacttccgttatagccaaccagaggactttactgatggattaccagactttgcaatgaccgatgtttcctttatttcgttgcataagattttggtacctttaaaaccaattctcaaacctaattgtgatgcggtggctttaattaagccccaatttgaagcgggtccagctaatgtaggtaaaaacgggattgtccgtgatcctaaggttcataaaaatgttgtgacagatatcgtcaactttagtttagcaacaggctacgatgttttaggccttgatttctcaccaattaaaggtggcgaagggaacatcgagttcttgatccatcttagaaatacagaagccgagacgggcacacttgctgaaaatgtgaatattgatgcggttttagaacgagcttatgcagaattaaaacgaccttctggaaaataaatgcgtaaagtagaccgacaacgactgttgagaaatttaattcaaactcatgaaattgaacgccaagaagactttgttaaactcttacaggcggaacaaattgaggtcacgcaagccacgatttcgcgtgatatcaaagaaatgcagctggtaaaagttcccaatacggacgaaggctatcactatagcttaccgctcgaaaagaaattagacgttaaagaaaaattgcggcggacattacgagatgcctatgtgacccataatcaacaggattattttgtggtgattaaggcgcatcctggtaacgcaccagcaattgcaagtttattagatcaattacaatccgaagatatttttgggacaattggtggcgatgacacggtcctgattatttgtaaatctgaggaacaagcaaaacagttcagattatttatcgaagacttgctaaagtaaatgctacaagaattagtcattcacgactttgcaattatagatcaattggccattagtttcgatgaagggatgacggttctttctggtgaaactggggccgggaaatcgattattatcgacgcggttggcctactcgctggtggtcgggggtcacaggatttcatccgaaccggtgcgaaaaaagcgacattagagggcttgtttacattacccgaaaacggcacgactgccgcgcttttagctgaatatgggattgaacatgatgatcaaaccattttattacaacgtgatttggcattaaacgggcataatgtttgccgcgttaatgggcatctggtcaacaccacgacgcttaaaaagattggggaaacattagtcgatattcacggtcaaaacgaacatcaagaattaatgtatcctgatcgccatctaggcttgttggatgagtttgcccacacaaccttggcgagtgctaaggcggcctatcaagaaacctatcaggcttaccggcaaacggaaaaagcattgaagaaaaagcaacaaaatgagcaagaatgggcccaacgccttgatatgcttaaatttcaaactaatgaaattgacgccgcgcagttacaaccagatgaagaaagtaagttaatcgaagaacgcgcgaaactcagcaacttccaacggattaatcaggccttgcaagctagtcgcgccattttatctggtgaggaaggcaacgcgctagatcaaatcgcgattgcaatgaatcagatgcaagaaatcgcggaattagatcctgaattcaaaagaattgccgataatctacaaacaggctattacacattgcaagatagtggtagtgatattagtcgggaagtcgataatcttgaatgggacgaggcacgcttggatgaaattgaacagcgcttagaaacgatcaataatctcgaacataaatatggcgattcaattcctgaaatcttaacttatggggcgcaaattaccaaagaattgcaagcgatgcaggccacagaagccaatgcaagcgaattagagcaacaatttgaacaacaacaagcccaattgctgcaagaagcagccgttctttctgagaaacgccaagcagctgctcaacagttggaaaaggctgttcaccaacaactcaaagcgctctacatggctaaaacggttttcaaagttgaatttgccacggttgatgaccagcaatttatgcgcagtggtcgggacaaagttgaattttatattcaacctaatccgggtgagaagctacggccacttgccaagactgcttctggtggggaattatctcgattgatgttggcgcttaaaacgattttctcagaatcacaaggcgttaccagcattatttttgatgaagttgatactggggtcagtgggcgtgttgcgcaagcaattgccaataaaattagcgaaattgcccaacactcacaagtcctctgtattacgcatttgccacaagtagcggcgatgagtgatcatcaataccaaattcaaaaacaaattaaacaaaaccgcacagaaacatcgatccaaaaggtaaccggtaaaaaacgcgttgctgaactggctcgtatgttggcggggacagaagtgacggaattaacgctagaacacgcccaagaattagtggacctcgcagaaactgctaaagcacagattagacaagcttaattagttattttttgagatgtagcggatttgatttaaagtaacgattttataaagattagagtgattttcttttaacaagtaagtttgttcgtcgagttgcttaatcaagcgcccattgacttgttcgatgtgctcggccacgttaaattggatagccaaacggtaatggcgatcaaaagcttgcatcatataaagttgaatttggctagggtgcatctggggttgttcgattaattcttgggcatcatcgagttcgaaaaagcgttgataccgtttcaccaattcatgactaaagccgattactgctgattgtttgatttccatatgagtgatatcaactacgaaattatggctgaaattggggtcattagtgaaaataaggcgggctggaagaaagaattgaacttaattgcttggaatggtcgcgcacctaaatttgatttacgggactgggcacccgatcatgcgaagatgggcaagggcatcacgctcaccaatgaggaagttgcacaattgcaaacaatattaaatgagatgaacctaaagtagatgtccaatcgaggaatgttgatcgttttatctggcccatcaggggttggtaaaggaactgtccgtcaagcaatgctagaagatgaatttcgtgattttcactattcagtttcgatgacgactagaaagccaagaccaggcgaacaagatggtgttgactactattttgtgagcaaagaagaattcgagcaagaaattgcaaatgatggtatgctagagtatgcacagtatgttgataattattacggcacaccgatgaagtatgtcaatcaaaccttagaatcaggccgcgatgtcttattagaaatcgaagtccaaggtgcgatgcaggttcgtgagaagtgtccagatggcgtgtttatctttttaacaccgcctgatttattggaattacgcaatcgaatccaaaaacgtggcactgacgatcaagcaacgattgataagcgcatgcaaaaagcagccgatgaaattcggatgatggaaaattatgattacgctgttgtcaatgatgaaattccaaacgccgttcaacggattgaaaagattattgagagtgaacacttacgagtaccacgtgtgattgatcaatataagaaaatgataggggaataaatgattgtatatccttcaattgataagttactagaaaatgttaactcacgctattcattagccgttttagcaagcaagcgagcacatcaaatcgaagctggcgatttgaaaatgttatcagaatacaaatcacctaaaaccgtagggatggcaatggaagaaattgctgctggcaatgtaaccattgatcctgattcattgatgcttgaaaaagatgctgaaaaaatggataagctttctcaaaaagatggcgaataaatggtgagtttagaaaacaaacacgttacggtttacgtaaccggtgggattgcggtgtacaaggtcgctagtttagtgcgtcagttgattaaaaatggggcaattgtccgcgtggcaatgacgcaggctgccaccgaatttgtgacaccattgacctttgcgacattaacgcggcaagaagtgctaactgatttaatgacgatgaatcacccagaacaagtcgcccacattcacttagctgactggaccgaattggcaattgttgcacctgcgacggccaatattgttggcaaattagcgaacggcattgcagatgatttcgtgaccacggcacttttggcaactacggcgcctaaattattggtgcccgctatgaatgaacatatgtggttaaatcctgcgacacaacgcaatttaacacaattaaaagcagatgggattgcgattgtgcaacccgctactggttttttagcggaaggctatgaaggccaagggcgttttccagaagaagatgtgattatgagtaatgtttaccgccaattaacccctaatcgtttgcaagataaagtggttttagtgacggccggtgggacgcaggaacctttggatccggttcgctatattggcaaccggtcatctggtaaaatggggtatgcgattgctgaaatggcggctcaaatgggcgctaaggttactttgattagtacgcggccagaactggctgtccctgctaatctggcacaagtcatctatgtccgaactgcagccgaactgcaaggggccgttgctagtttatataatgaagcggatgtcgtgattatggcagccgctgtcgctgattttaaaccggcgcaatacgtttcacaaaaaattaaaaaacaagttggtcaaactgatatgacgcttgaactcaatcggacgctggatattttagcgacgttgggtcaagaaaagaaaaagcaatatctagtgggctttgcagctgaaaccaatgatttgatggcgcacgcgcaagtcaaattaacggctaaacaggtcgatttattagtggccaatgatgtcagccaaaccgaccggggctttggcgctgaccaaaatgcggtcactcttttacgaccaaatcaggcaccagaagcattaccattggcttccaaaaaagtgattgccacacaaattttagaacggatcagtacagcgcttagctcaaaggaggaatagatgccacagattgctaaagtaatcgttgatgtgccgacaatgcaaactaatcggccatatgattatcaggtaccggtcactttagttgatgtcattcaacctgggatgcgggttattattccgtttggaaatggtgatcgtaagattcagggctttgtcttgcaagttttagaccagccaagctttacgggccaattaaaggcaatcgaggcagttgttgatttaacgccagcggttaaccctgaattactatcactttcagattggttagcacaacagacgtacgcttttcagatcacgtgtctgcagacgatgttacccagtgtgatgcgggctaaatatacgaaaactgcgacgttaattgatgaaattccagcggacttacaggccagtctgttcaatggcaatgacgagttgacttttgatcagaatctagcgcctgataagttaaaacaactcatgcaattgcagcgccaaggtaaaattagcgtcacttatcacgttgataaccgggcacaagttaagcaattaacggcgattgagcccgcactgagttttgaacaattggaagaagcacggatgggtttacgaaagtcagcccagaagcaaagccaattaatcagttatctgcaaacgctgattgatcaagaggcaccaactttattaaaaacgattttagaaaaaacaacttttacgcgggaaaatattcgaatcggtgcggaaaaaggctggttacgccaagttaaggtggaagcttaccggaatccgtacgctaatgctgttcaaccaacccacaaaatgacgctaacgagcgaacaaaaaaccgcagttgatgcggtcgttcaatccgcatcaacggatgcctcagaagtattcttaattgaaggtgtcaccggcagtgggaagaccgaagtttatttacaaacaattgatgcggtcttgcaacaaggcaagaccgcactgatgttagtccctgaaattgctttgacgccgcagatggtgcaacgcgtgaagggccgctttggtgatttagtcgctgtgttacatagtggcttgtctgaaggcgaaaaatacgacgaatggcggcgcattgaacgcaaagaagcgcgcgtggtcgtcggtgcccgctcagccgtttttgcgccacttgaagatatcggcgtgattattatggacgaagaacatgaagccagttataaacaagacgaaagtccccgttatcatgcacgcgacgttgcgatttggcggagtcagtatcatcactgcccggtcattttaggcagcgccacaccatcgttagaatcccgggctcgggcgcaaaaagatgtctaccatctgattcgcctgacgcaacgggtgaaccaacaagccttaccagctgttgaactagttgatatgcgcgaagcgatgaaggttcaaaaagccagcaacttttcaccagcgttattagccggcatcaaagaacggatgcaaaagggcgaacaaagtgtgttactcctaaatcgccgtggtttttcatcatttatcatgtgtcgcgattgcgggtttgtcttgcagtgtcctaactgtgatatttcgttaacgctgcatatggatacacactcaatgaaatgccattattgtgggcacgaagaagcgattcctaagatttgtcctagctgtcagagtcgtcaaattcgttattttgggaccggcacgcaaaaagtcgaagctgaattacaagaattaatccctgaagcacggatcttgcggatggacgttgatacgactcgcaaaaaaggcgcgcatgctaaattattgaaaaaatttggtgatcacgaagctgatatcctattagggacgcagatgattgccaagggcctagatttcccagatgtaacgttagtcggggtgatcaacgctgatactgctttgggtttaccggattttcgggcgagtgagcggactttccaattattaacgcaggttagtggtcgtgcgggtcgtgcggataaggtgggtcaagtgattgttcaatcttataatcccgagaattacgcgattcaatttgctaaacagcacgattatgaaggcttttatcaatatgaaatggcggtgcgccaccgtggcggctatccgccttattactttacggtgaaggtgacggttagccaccctgaagaagcacttgccgcaaagaagagttttcaaattgccaaacagatgcgaccgattttatccgaccaagcactgattctcgggcccaccccgaaatcaattgctcggattaataatcgttatttttaccaaattgtgattaaatataaacaggaaccacaacttcaggctaaattagccgaaatactagagaccacccaaatcgatactcgtcacgggtttaagattgggctggataatgaacctctacaatttacttaaatgacatccatcgtatttatgggaacaccccaattttcagtaccaattttagaagcccttgtggcaaacgactaccaaatcttggcagttgtgacacaaccggatcggaaagtcggtcgtaaacaagtgttgcaacaaacacctgttaaagaagcagcagttcgactagatctaccagtattccaaccagaaaaactgagtggtagccctgaactggctgacgtaattgccttacaaccggatttaattgtaacggcagcttacggtcaattcttaccaacaaaattattagaagccgctaaaatcgctgcgattaatgttcatggctcattattgcctaaataccgtggtggcgccccaattcaatacgccgttttaaatggcgactcagaaatcgggattactatcatgcatatggctaagaaaatggatgccggcgatatgattgaacaagccagtattccaattgaagccacagacgataccggtagtttattcgataagttaagctatgttggtcgggatcttttactaaagactttacctgggattattgcacaaacagcccctcggacaccgcaagatgaagtgcaagtgacctttgcgtataacattactaaggaacaagaacaattagacatcaaccaacctgctgaacagttggttaaccaaattcgcgctttacggcctcaaccaggagcttggttagccgttaatggccaacggactaagatttggcaagcgacagttgcagaaacaacaactgatcaagcagccggcgtagttgtcgcgctaaataaaaaagatttcgaattagcggccggtaacgggactgttttaaaaatcactgaaattcaaccggccggtaaagccaagatgccagtgcaatcttatttaaatggggttggcaagcaactagcagtcggtcaacaagtggtggtgcaagatgccgaataaatgccgaataagacaccgcgctacttagctgttgaaatattgacggcaattgccaaacaaaatagttattcaaacttggcattagaccaagtgatcaataagaatcgattaaacccacaagatgctggctttttaacgcagcttgtttacggtgttattcagcatgaatacacgttggattattatttagcacctttcattcaaaagccgaagaaaatggacaactgggttcgccaagttctcagaacagcggtttatcaacaagtttatttggatcgcgtgccagaacatgctattttttacgaagcaactgaaattgctaaaaaaatggggcatgcgggggttgctaagctcgtgacggcgattttgcggcagttacaacgcagtggtttaccggatctcaatgcgattgctgatccaattgaacgtcttagcgtgcaatacagcgtgccgcaatggttggtggcaaaactgcaagctgatttaggggatgataaactcgaatcattgctcgcaacaattaaccaaccagccaacgcttcattgcgagttaatacgcgggtcaatacggttgatgccgtattggctgagttacaaccgcagtttaatgacctccaaccgagtcagattgctaaggttggcttagtcgcacaaggcggtcatttggccagtggtacgttatttgaagcgggcgattatacgattcaagatgaaagttcaatgttagtcgcacctagtttagatattcaaccaggggaccaagtattagacgcttgtgccgcacctggtggcaagacaacgcatatggcaacttatttggatgcgcaacaaggcggtcaaatcacggccttagacattcatgaccataaagtgcgtttgattgaacaaaatgcgaagcggctccatgttgaagatgttgttagcgcccaagcactagacgcacgtaaggtgggcgaacagtttggtgagtcacattttgataaaattctagtcgatgcaccttgttcaggtttaggactaatgcgccggaaaccagaaattaaatatagccgccaaccagcggacttgatgaatctacaacgaatccaattagcaattctagatgctgtggcgcctactttgaaagtcggcggacgcctaacttatagtacatgcacgattgttccggaagaaaatcaacaagtggtggcggccttcgttgctaaccatccggagtttgaaattgaaccagtgccacttgaattaccattagcgcaaaatcaagcaagtccttttgtccaaatctatccagatgattaccaaacagacggctttttcatcgcttgtttgaaacgacgggcataaatggaagttgcatatcaaacagatgtcggtcaacagcgacagaataatcaagattatgttggtttttatactaatcaacgcggtgttcaatttgcaattgttgcagatggaatgggcggtcatttaggaggcgacgtggcctctgaaatggctgtttcccatatcggacatgaatttgaaaaaacagatgataccgatattgaagcgatggttaagtggttgatttttgaattacaaagagaaaaccaacatattttagccaaagcgaatcaatatgacgatttatcggggatgggcacgaccttagtggcagtcttaatttccgggacgcactatttagtcgctaatatcggcgatagccgcgtttaccgtctcagacgcaatacgttacgtcaattaacggaagaccactcattggtcaatgaactggttaagcaaggggaattaacggcagaagccgctaagcatcatcctcaaaagaatatcatcacgcgcacactgggtgtttctcaagaagtagatgcagatgtgacgatttatgaattcgaaccagatgactacttacttttatgtacagatgggttgaccaatatggtcgatgacgatcaattgcaacaaaccttgatggcagagatgacgctggaagaaaaatgtgccgccttaatccaaaaagcaaacgaagctggcggcatggacaacattacggcactcatcttacatcacgaaggtgaggtgcttacgccatgaatgatggaaacagggtacgctgtagcggggcgttataagattattcgccccatcggtgaaggcggcatggctaatgtttatttggcgcaggatctaattttagatcggcaagtggcagttaaagttttacgattagatctccggaatgatccagacacagtccgacggtttacgcgagaagcgttggcaacgactgaattaaatcatccgaatattgttagtatttacgatgttggtgaagaaaacagtatgcaatacatcattatggaatatattaagggcaccgatcttaagaaatatatcgtggaacactttccaattccttatcaacgcgtaattgatattatgacgcagattttatctgcggttcaaaacgcacatgcgcataatattattcaccgggatttaaaaccacaaaatattttggttgatgaagacggcaatgttaagattagtgactttgggattgcgattgcgctcagcgaaacagcgatgactcagaccaacacgttgttggggtctgtgcattatctctcaccggaacaggcaagaggctcgatggcgacgaaacggtctgatatttactcgttaggaattgtgctttatgagttattgacggggatggtgccttttgaaggcgagtccgctgtttcaattgcgattaagcatttccaagatgaagtcccaccagtacgcaactatgatccacgtattccgcaagccttggaaaatgtcgttttaaaagcgactgccaaggatccggatgaacgctatagtggtgttgatgcaatgatggctgacttagcaacttctttatcagctagtcgtgcgcacgaacctaaatttgtgccatcaaaagcggatgatttgagtgagactaaggtgattcccgcactagatccagaaggcattacgcaaaccaacaacgatgaggaacaagtcaaagaagcagagccaactcagaaaaaggttaaaaagccagctaagtctaaacgtaagtggtggctactaggtggcggtgttgttttattgctgttattagcaacggtgattgcttttgcagttcaggggagcgaagtaaccgtccctgatttaacggatatgacacaacaaaatgcggaatctgctttgaccgataaaaaactgaaggtcggcacggttcaaaaaacaacgagtcagaaatacagtaagggccacgtcattcgaacaacacctaaagcgggcctgagtgtaaaatcaagaagtacggttaatttaattgtcagttcaggacgccaaaagtataagattaaagactatacgaaccaagcatatagtgatgttcgggatgctttgaaggataaaggcttgaaagttaaacggaaataccaaagttcatctgaagtgagtcctgggttgattatcgatcaaagtattgcggctggcaaaagggtcgttccaagtaaaacgacgattaccttaacagtcagcagcggcaaacctggttttgcattgcataatctaagcaactatacaaagcaagggattcaagactatgctgcacaaaatggtttaacggtcgtattctctgaagaatattcatcaagtatttctgaaggaatggtaatcagtcaatcgcctgcaagtggtacaatggttcaagaaggtgatagcgtaagcgttatcctttcaaaaggcgagcaaccaactgaacatcattctgttgtgacgtcgagttcaaattcagttatcgagtcgagtgcgcctgaatcaagtcaatcgagtgaaagtagcgcgagtgagtcagagagcgaatcagagagtgaatcggaaagcgaatcagcaagtgaatcgatcagtagttcagctagtcaaagtagtcaatcgagcgttcaatcaaagtaattgcagaccggacagattattcgtgccctcagtgggttttatgatgtacaaagtgagcacaaaatttatcgaacacgggctcgaggtaattttagaaaacggaaaattacgccattggtcggcgatttcgttgaatttgaaagtgaaagtcaaacagaaagcggatatatcttagaaattttagaccgcaaaaatgaaatgattcgaccaccagtagcgaatatcgatcaggcagttgtcattgtttcggcagtcgaacctgatttttcgttaaacttattagatcgtttcttgatttatttagaaagtttgaatattcaaggcctcgtttatttgacgaaaaccgatatgatttctgacgaaaaatatcaagagattaagcaatatttggattactatgaaaaagtgggttatccaacttttgcacccagaacggcatttacaccagagattattcaagcgattgaagacacattccctgataaaacgaccgtctttacgggacaaacaggggctggtaaatcaacactgcttaatcacattgatcctaaattgaacttagcaacggctgaaatttcacaaagtttaaaccgtgggaagcatacgacgcgccatatcgaactaattccattgaacgatgggttggttggcgatacaccaggcttttcatcactgggcattttaaatgtgacgagtgaaactttagtgagtcgttatcctgaatttagagaaattggacaagattgtaagtttagaacttgccaacatgtgatggaacctaaatgtgcggttaaagcggccgttgatgctggtgaaattatgcaaagtcgctatacgaactatttgcaattccgggctgaattaaaggatatccggcctgtttataagaaatcaaaataaatgacacaaatcgcaccttcgattttaagcgcagattttatgaatttacaacgggatgttcaaaaccttgaggcagcaggtgccgacctattgcatattgatattatggatggcatgtttgtgcctaacatgtcttttggcgcccaagtggtcagcggtattcgtccgctaacacaactaggcttagatgttcatttgatggttgaacaaccagaacgctacattgaacaattcataacagctggttctgatttaatcatgattcacgcagaagcaacagaacatctttatcgtggtcttcaaatgatcaaagatgctgatgttaaagccggggtggtcatcaatccaggcacaccagtgagctacattgaatctgttttaccattggttgatcaagttttagtaatgacggttaatcctggttttggtggtcaaaaattcattccagcaatgttaacgaaggttgctgaattagcgacttatcgtgaaacacacgctgatactgattttacaatcgaagttgacggtggtgttaacgaccaaacaatcgcagcctgtgccaaagcgggcgctgatgtctttgtagcgggttcatacacatttgctggtgatttagcaacacggattgaaacccttaagaaggctgctaatgaagcgcgttaaatgaagcgcgttaatttattggcaggtggtccagttgatcagtgggcatcggaattagcgacaatcacaacggtcccaggacaatggattacggccgatcgtgggacgttacgcttattgcaacaaggcgtgacacctacgattgcggtcggtgattttgattccattaccccggctgaaaaagaacaggtgctagcggcggtcagtgatattcgttcggttcaagccgaaaaagacgaaacagatacgcaattagcgttatcgattgcctttgaagaactacaggctgaccgtgtggtggtctacggtgcgactggaggccgaattgaccatttcttagccaatctctttatggcggtcgaagaacgctttagaacggtcctcaatcgcattgagatgcgtgaccggcaaaatacgattcaattctatgcgccagggacgtatgagctgacaaaagaggctgataaaaagtacctcgcgtttatcccactcgtgccaacgacggatttaaatttagtagatgagaaatatccactcacacattttgatacgaaggttccaatctcatgggccagcaacgaattcatcggcgaaaaagcgcattttaattttaaaacgggcatcgtagcggtgattcaaagtaaggattaattaaacacgagtaactttgcctgatttcaaagcacgagcagaaacccaaacacgtttaggtttgccatcaactaagatacgtactttttgtaaatttggcttccaagaacgacgagatgcgttcaaagcgtgtgaacgcttgttgccaaatgatgttttacggccggtaataacgtcttttgccatatggctgttaaaattaagacccaatacggcgatatcgatattacgaataatgtgattgccactgtcgttggcggtgctgcaactgatatttatggcatcgttggtatggcaagcaagaatcaaattcgtgacaatttaaatgaaattttaaatcgtgaaaattacaatcggggcgttgttgttcgtcaagaagaaaatggcgtggcaatcgacgtttatattatttgtggttatggcattaagatctcagaagtttgccgtaatgttcaaagtaaagtgaaatataatcttgaaacaatgttgggtgttagtgcaaactcagttaatgtttatgttcaaggtgtacgtgtattagaagactaagtgaaagttactgaaattacagcaaccgagtttcaagcaatgatgcgggttgctgcacatcgcttaactaaaaatgcagaatttgtgaattcattaaacgttttcccagtacctgatggggatacaggaactaatatgagtttaacttttcaaagtggtgctaaggcggttaatgaaaataatgcgcaagcagttggtgaattatcaaagagtttagctaagggtctattaatgggtgcccgcggtaactctggtgtgattagttcacaaatcttccgtggcttttcaaagagtatggaagaaaaaacaagtttaacggcccaagatttagcagatgcttttacaagtggcgttcaaacagcgtacaaagcagttatgaaacccgttgaagggactattttaacagttgcgcgtgaaggtgctaaagcgggtgccaaagtcgctgcacaaacagatgatattggtgcagttgttgaagcggtcgttgaaggttctaagaaggctttattgaagacgcctgaattattacccgtcttaaaagaagtcggcgttgtcgattctggtggtcaaggcttagttttcatatatgaaggtttcttagaaggtttaacaggtcaagcacctgccaaggacctttacacacctgatgaagctgaaatggatgaaatggttaatgctaatcatcaccaaacagcacaaatggggactgaagaaatcgaaaatggttactgtacagaaatcatggtcgcacttggcgatggcacaactgttgatcgcgaatttgactatgatgaattcagaaatcatttaaacggtattggcgactcattattagtcgttgccgatgatgaagtggttaaagtccatgtgcatacagaacatccaggaacagtgatggcttatggtcaacattttggttcattgatgaagatcaaagtggacaacatgcgcttgcaacatgatacaattgttgaaaatgatcaacaagcagcagcacccgttcaagcggaaccagttgatactgggattattgcgatttcagctggtgctggtgtggcagaactcttcagaagtttaggggccacttatattctaagtggtggtcaaacaatgaatccaagtacgcaagatattttggatgccattcaagcagctaacgcgaagaaagttattttattaccaaataataaaaacatctttttagcggcggaacaagctgccgaagttgctgaaattccggttgaaattgttcaaagtcggacaatcgcacaagggatgacagctctcttgtcatttgacccttctgcagaattgcaagctaaccaagtagcaatgaccgaagcacttgatacggtgattagtggtcaagtgacacaagccattcgcgatacaacgcttgatggtcttgaaattaaaaaagacgattacatggggattatcgacggtaagattaaggtctcaactgctgatcgccaaacagctgccatcgaaatggttcaaaccatgttggatgaagacagtgaaatcgtcacaattatcgttggtgaagacggtgatatgacagaagctgaagccattagtgatgcaatcatggcccaagacgatgaattggaagttgaaattcacgaaggtgaccaacctgtttatccatatttaatttcagttgaataagtgttaagtttaacggattctgtgactgttttaacgggtgttggcccgaagcgtttgacagccctcaatcaattaggaatcgcaacaatcagtgatctattgtattattttccgtttcgttacgaggatttaaaggttaaggatctctcagaagcggtcgatcaggaaaaggtcaccttaaaaggaaccgttgtcgctgatccagtcgtcagtcgttggggaccgggtaagacacggctaaacgtccggttattgattaatcatgatgtcattatggtgacttttttcaatcaaccctacttgaaggataaatttgaagcaggcgttgatattgctgtttatggtaaatgggatgctagacggaatagtttaaccgggatgaaggttttagcggttcaatcggctgataatccttcgttcgcggcgatttattcaaccaataaaaacgtgcgtcaaggcacactcgtaaaattgattcgcgaagcgtttgataattatcgcaatgtcattccggatttgattccggccgatattcgcgagcggtataagttagtttctgaagtggaactgattgctggaatgcattttccggaaagctacccagaagccaagcaggcgcgacgcaccgccatttttcatgaattcttcttgtaccaactgcaattgcaggcgattaaacaagcagaccgccatgttgaaaatggcttagcactgccttatcaaaacgcagccctcaaggaatttattaagacattaccgtttgatttaacggatgctcaaaagcgggtggtcaacgaaatttgtttagaccttaaggcaccggcacatatgaaccgtcttttacaaggggatgttgggtctgggaagacgattgtcgcggcgattgcgatgtttgctgcggtgacggccggtttccaagcggccttaatggtgcccaccgaaattttggcggaacaacattatcagagcctacaaaagctttatgcaccaatgaatgtgacggttgggttactaactggttcgacaaccgccaaggagcgccggacgttgttggcggatattgaatccggtcggatcaatatcattgtcggaacgcacgcacttattcaagatgccgtggtttaccacaagttaggctttgccgtcatcgatgaacaacatcgatttggggtcaatcaacggcgcgtgctacgtgaaaaaggcttgcagcctgatatgctggcaatgacagcgacaccgattccgcggaccttggcaattaccgcctatggcgaaatggatgtttcgaccatcgatgagttacctaaaggtcggattccaattgaaaccagttgggtgcgtagtaaccaggttgaacaagcgctctcgtttgttcaaaaacaattggctgacaactcgcaagtttttgcgattacgccgttaattgcggagtcggaacaaatggatctcaaaaatgcggaagaaatctacgcgactttggcggatcggtttgagccgcagtaccatgtggcgctattacacggtaagttgaaggatgacgagaaaaaccggattatgacggctttttcaaataacgagattcaactactggtttcaacgaccgtcgttgaagtcggggtcgatgtgcctaatgcgaccgtgatgatgattttcgatgctgaccggtttggcttagcccaacttcatcaattgcgtggccgggttggtcggggcaagaaaaaggcctactgtctattgattgccgatcctaagaatcaacaaggtgtagatcgaatgacgatcatgaccgaaacgaccaacggttttgttgttgcgcaaaaagatttggaattacgaggccctggtgaggtctttggcgatcggcaatcgggattaccagtcttcaaggttggtgatccagtcgctgattttgccagcttacaggtcgcacaacaagaagtacaaaaaatcttcacggttgatcctacttttagccaaccggcgtacgcgcctttaaaagcgtatctcgcacaacaaaaacaaaactatcaaacattagattaaatgaaagtagcagttgatgcaatgggcggcgatttcgcgcctcaatcagtaatcgaaggggttttacaagcccgttcagaatttacggacctagattttattctatatggcgatcaagcacagattgaacccttaatcgatgatatgacgcgcttaacaatcgtgcataccacagaaaaaattgcgagtgatgacgaaccagtccgcgctattcgtcgtaagaagcaggcctcaatggttttagccgcccaagcggttaaagatggccaagcagatgcactcttctcattagggaacacaggggccttattggcagccgggttatttattatcggccgggtaaaaggaattgatcgtccaggcttaatgcccactttaccatcgattaattctgatcaaggtttcaatatgttagacgttggtgctaatgctgaagctaagccagaacacttgcatcaatacggtttaatgggtaatttctatgctaaagacgtccggggcatcgaaaatccgcgaatcgcattgttgaataacgggacagaagcgactaagggtgacgaattgcataaggcaacgtaccaactcttagcagatgatccagatttgaactttgtcgggaacgttgaagctaacgatttattaaaaggtgttgctgatgttgttgtgacggatggctttactggcaatgcaacgttaaaagcaatcgaaggcactgccacaatcgtcatgtcacaagtgaaacacgcgattatggatgctggggtcaaagaaaaaattggtggcctattattaaaagggagtgtcgggggtatcagagaaaaatttgatacgtccatttatggcggggctgttttacttggcttgaaagcacccgttatcaaggcgcacggggctgccgatgcacgtacagtctactatacggttaaacaaattcatgcgatgttagctaatcaaacggttcaaaaagtcatcgattatttcagtgaccaagctgcgcaaaagaattctaattaaatgagtgaacaagaaatctttgataagattgcagcaattattgctgaccgatttgaattgacccaagaccaggtcacaaatgaattgaactttaaagcagatcttgatgctgattcaattgatattgttgagttcgtcttagaattggaagacacgtttggtgccgagattccagatgaagaagctgaaaaaatcgcaacagtggcagatgccgttgcatacattaaagcgaagaccaaataaatgagacgagaaaagggtttagtattaggtgtaacgacggtggcgataacattattattggcagcgtgtggttcctcaggtagcaagaatgcaggttcaacagatacggttagtttttcaacaaccgatgtgatttcaacgatggatcctgcattgaacaccgacgtgattggggcgcaggcgttaacggacacgatggaaggtctttaccgttatgaaggcaagaccattaaaccagcgattgcgacgaaagtggttaaaccaactaataatgggttaacatatactttcccattacgtaaagatgcaaaatggagtaacggcaaagctgtgacagcggaagatttcgtctatgcatggcgccgagttgtcgatccaaaagttggctcacaatatgcttacatttatgaaggtattgaaaatgcagcagccatcacttcaggtaaacaacccgttagttcattaggggtagttgccaaagataaacacacattacaagttactttagaaaaaccaattccatacttcagtcaattaatgaccagttcaacattcttcccagtttatccagatgctgttaagaaagccggtaagagttatgggacaaatgctaagacattagtcttcaacggcccttacaagttatctggttggaacggcccagatagtgcttggaaagaagttaaaaatactaactactggaatgctaaagctgttaaagttaaaactttgaaataccaagtggttaaagatccatcaactgctttgaacttattccaaagtaataagcttgatcgcacaaatatcagtggtgatactgctaaacaaatgaagaatgattctcattattcaacacaacaacaagctgctacattctatatgcaagttaaccaagctaagaacccaatcttcaagaatgccaagatcagacaggcaatctcaatgacgattaaccgtaaagagttggttaaccaagtattgggtgacggttctgcaccagtagcctcattaacaccaaaaggcatgagttttgaccccacgactaaaaaagatttcacaagtgagttaaatgccgagggcaagaaaaatacaacctataatcctaaagaagcaacgaagctttggaaggaagggttagctgaaaccggtcaaacgggtaagacgtttaactatacattattaggtgatgatacggatactgctaagaaacaagcagaatatctccaagatacgcttgaaaagaacttacctggtttgaaggtaacacttgccaacgtaccatttaagacacgtttaacacgttcggataacggtgatttcgatatggttgtcagtgcttggaatgctgatttcccagatccaattacattcttagacttattcgtgacgggtggcgacaacaataacggtaagtggagtaatcctgaatttgatgctcaaatcaaagcaagcaaaacagaaaatgccaataacgacaaagcaagatggcaaaatctcatcaaagcccaagatattatgaataaagaatctggtgtcattccattgtatcaatcaggacgtgcgtacctcactaactcaagcgtcaaagggttagattacggcccttctggaaattacaataatgtctcactttatttaaaaaaataaatgagtaaatatttgattaaacggattttttacctagtattaacgctattcattgtcgcttctgtgacgttcttcatgatgaaactgatgcctgggacgccatatacgaatcaacaaaagatgagcgctgatcaattaagaattatgaacgaacaatacggtttgaataagccgttgttccaacaatatattatttacctgggtggtttgttgcacggtgattttggaacgtccttccaatttaataatcaaccggttgccaacctcatcatgacgcgtttaggaccctcacttcaaatcggggcccaagccatgcttttagggtccgttttaggggttttattaggggcagttgcggcaattcgcaagaatacttgggtggatggcgtggcgacgttcttttcaatcttagggatttcaattcccaacttcgtcttagctgttttactccaattcttcttagccttcaaattacaaatgttcccaattgccttgtgggatggttggtcatcaagtatcctaccatcgttagcgttagcagtagcgccattagctaatacagcccgcttcatgcggactgaaatggtcgatgtcttgagtagtgattacatcgaattggctaaggccaagggaaactctaagtggcaaatagttgccaaacatgcgcttcgtaattcgatgattccggttgtgacaatcatcggtccaatggcggtcaacttaatgactggttcattggttgttgaaaatatcttctcaattcccggtattggggaacaatttgttaaatcaatcatgaccaatgattatccaaccatcatgggcttgacgattttctactcattcttattaaccgttattattttagtcgttgatattctatacgggattatcgatcctcgtattcgattaagcgacggtcagggggtacgttaaatggcagatgcgaagctaacagcaggatcttttaaaccacttaataaagatacacatgaagaacaagaaaaaattagtgcaccctcattaacgtttatgcaagacgcaattcggcgcttgaagcaaaataaggtggcggtggtctcactattcgtattgttgatcatcatcatcgcggctgcattggcgcccgtgattgcaccgcacaatcccaatacgcaaaacgtagcgtatgccaacctcccacctaaaattggtgacggtcaaatcccaggatttaaaggtgagatggacgtttccggtgttaaagttgataaatatcaacaagctggtgtccctaaaggcaagtatttcattttagggactgattacctcggccgggatttattctcacgaattctttatggaacgcgtttatcactattgattggggtcttagcgacgctcgttgatttgttgattgggattccatacgggattatctccggttggcggggtggtcggattgatacgttcatgcaacggtttattgaaattatctcttcaattcccaacttaattgttgtggtgctgatgatgttaattttacgaccagggcttttatcaatcgtcattgcgatcggctttaccggctggattacgatggctcgactgattcgggcgcagaccttccaactgaaagaacaagaatttgtgcttgcggctagaacgttaggcgagacaccgttcaagattgcgatgaaacatttaattcctaacttatcatcaacgattattattcaaacgatgtttaccattccgagtgcgatcttcttcgaagcattcttaagttttattgggattgggattcccgcacctaacgcatcgctagggactttattatctgacgggcaaaaagccttccgattcttaccctatcaaatgtggtacccagcagcagtcttatgtgtcatcatgattgccgtcaacttactagcagacggcctaagagacgcatttgatccaaaatcataaatggcaaatattttagaagttaatcatttaagtattgattttaagacctatgcaggtgacgtccacgcaattcgggatgttagttttaaccttaaaaaaggggaaacgctagccattgttggcgaatctggatcaggtaaatcggtaaccgtgcgtagcgttatggggttgctggccagtaacgcccacgttaaagccgggactgtcatgtaccatggcgatgatttattgaaaaaaccagaacgtgaaatggatgcgattcgcgggagcgatatctcgatgatcttccaagatccgatgacctcgcttgatccaaccatgacaatcggcaaacaagtggcggaaccattgttggttcacaaaacgatgaacaaagaagatgcgatgaaacgagcacaaaccgtgttagaattagtcggcattccgaacgccaaagaacggatgaaagattatccgcaccaattttctggtgggcagcggcaacggattgtgattgcgattgcgattgttgattatccgcaaattttgattgcggatgaaccaacaactgccttagatgtaacggtgcaagcgcaaatcatcgacttgatgaaggaactacaacgcaaaattgaaacgtcaatcatctttatcacccatgatttaggcgttgtggccgggattgcggatcgagtagcggtgatgtatgccggcaagattatcgaatacggtttggtggacgaagtcttttatgaacccaaacatccgtatacttggggcttattaaattcgatgcccacactcgaaacggcgggcaagttagaggcgattccggggacaccgccagatttattggacccacctaaaggggatgcttttgcacctcggaatccgtacgcactgcaaatcgatgtggaagaagaaccgccattctttgaagtttccaaaacgcattttgcggcaacttggttattgcatccagatgcaccagcggttgaaccgccagcagcaatccaagctttgatgaaaaaacataacgttctttaaatggataaacagcaacgtaaagtcttagttgaagtcaaacatttaaaacaatactttaacccgggcaaaaaatccgaagtgaaggccatcgatgatatttccttcgagatttacgaaggtgaaacattcgggttagttggcgagtctggttcgggtaaaagtacgactggacgcagtattatccggctttacagcccaacaagtggtgaaattaattttgatgggcaagatatcagcaaaatcaaggaacacagtcgccagatgaaggaattccgcaaagaaattcaaatgattttccaagatccatacgcgtcacttaatccgcggatgaaggtcaaagatatcattgctgaaggattgcacattcatcatttggtcaaaaatgaagccgaaagtgatgcgcgcgtcaatgaattgctcgatttagtcggactcaataaggatcacgcaacgcgttatccgcatgaattctctggtgggcaacggcaacggattggaattgcccgtgctttagccgttaaacccaaatttatcattgcggatgaaccaatctcagctttggatgtgtcgattcaggcgcaagttgtcaacctgatgaaagagattcaggaacaacaaaacctcacgtatctctttatcgcccatgatttatcgatggtgaaatacattagtgatcgcatcgccgttatgcataacggtaagattatggaattggcatcagcggacgatatttacgatcgcccactccatccgtatacgcaaagcttattatcggctgtgccgttgcctgatcctaagattgagcgccaacgtcgccggatgccttacgatagttcaattgaaagtgacgatggtgatcgccaattacgagaagtcgcgcctgaacactatgtttatgcgactgaagcggaagttgcgtcttaccaatcagctttagcgacacttgtgcaacaagctaattaaatggggtatttaattttggatgcagcactagtcagcgagcttcgcgcccgttatggtattgaatttaataatttagcacttttggacgaagcgttcacacattcgtcttacgttaatgaacatcgcgagttaggcttgcgggacaatgaacgattggaatttcttggcgatgccgttatggaaattacggtctcagaatacctctacaaaaagtatcctgactggccagaaggtaagttaacacgtttacgagcagcgattgtctgcacgaagagtttcagtagtttttcaaaagaagctcattttgaccgttacattcgcttagggaaaggtgaagagaaaaatggggcccgcgcccgggcgacacttttggaagatttatttgaagccttcaatggtgctttgttcttagaccaaggtcgcggcgccgtcgttgattttgtttcacaagttatttttcccaagattgaagccggtgaattctcagatcaaacagattacaaaacaaacttacaagagttcttacaacaagatggcgaaatcgaaatcgactatcaattgttagcggaagttggcccttcacatgaccgtcaatttgaagtggatgtgttagttggcgatcgggtattaggctctggtgtgggtcgcaataagaaagctgccgaacaagcagcagctaaaaaagcgttagaacaacttaaagcataaatgcagttaaaatcattagtcttatcaggctttaaatcatttgctgataagacagaaattaatttttcagacggcttaaccggcattgtcggcccgaacgggagcggtaagagtaatatcacagaagcaattcgttgggcgatgggcgaacaatcggccaagagcttgcgtggcgagaagatgcccgatattatttttgccggtactgatttacggcctcagatgaaccgcgccgaagttacgttgaatttcgataatagtgaccactatttaaatcaagaactagataatgtgacgttaacccgtcgcctatttcgtaacggtgatagtgagttttatttaaatcaaaaaagttgtcgattaaaggatatcgtcaacttatttatggattctggcttagggcgagaatctttttcaattatttcgcaaggtcgggttgaagctatatttaacagtaaacctgaggatcggcgcaatatcattgaagaagctgccggtgttttaaaatataagcaacaaaagaaaaaggctcaatcggaattagatcaaaccgatgaaaatttaagtcggatcgccgatattgtttacgaattaaagggacaagttgaaccgctcaaagaacaaagcagtatcgcgcaagattatttggaacaaaaagcgcaatttaacgccttacatcaacaattgttagtcgttgaaattgatcaattagcagcggatcaaacgcaataccaagcgcaagccaagacactcgctaaggcactaggcgagattgaaagtgagattcaagaaaccaataaggcgttggccgataaccaacaggaagtcgcaacgttagatcaagaaattgaaacggccaatgaaaccttgttggttaagagtcgcttggctgaaaatttacagggtcaagaaaatgtttctaaggaacgggctagctatactgatgctaatcgtcaaaacttggtcgatcgaatcgcccaattagaaacgcagtcaacaacggctaagcagcaacaaatagcactcaaggcaacatacacagaaaaagttgcgacattaactgacttgaaaaatgagttagcaaccttgaaacgacaagcatcaggtagtgaggccgaattaaaggcgaagattgaacagatccgccaagactacatcgatcaaatgcaagcccaaacaaccaatcgcaacgaacaacaatatctagaaaaagccttgctacaaacgaagacacaattaacgcgccaagatagctcaatcaatgaaaccagtgcgcaattgacacagatgcaagctgacaaggtggccaaagaagcacaagttgcccaattagcaacagactacgcggctttagaaacgcaactaagtcaattacaacaacaaatcagtgcgacacaaaagcaatatcaaacggaacaaaataattggttccaagcttctggtattttacaaaaggcaaaagccaaacaagccagtttagctgaattaaacgatgattacgccggcttttatcaaggtgtcaaagcggtcttgaagcaaaaacaacaattacctggtttactgggtgcggttgctgaattaatgacagtgcctaatgactatcaacaagcgattgaattagcattaggggcacaattgcaacaaattgttacgacagatgaaaagacggcgcaacaagcaatcgattatttgaaacgtaatcgactgggtcgggccacctttttaccaaataatgtcgtgaaaccgcggactttaccaagcagtttggtgaaccaactacaaacagaacccggttttattggtattgcgagcgatttaattcagttcgacgatgctgttaacccggtcatgatgcatttgatggggaatttaattatcgccactgaattgacagaagcaattaagattggccgtctgacaggacatcggtaccgaattgtcactttagcaggtgatattttaagtccagggggttcaatgactgggggccataataatcgccaaaataatggtggtttattggcacggaagcaaacattaacagatttggaacaacaaattagtaaaatgcaattggctttggatcaaaagcaaaccaaggtacaagctttacaccaagatttggcagagcaacaggcgcaacttgaacaacaacaaggtgcctttgaaacagctaagacgcattaccaaacacaaaaaaatgagttgacgttattaaacgaacgtcttacgcaattcgaacgccaacaacaagcgactgattatcaagttcaacaacaacaacaaagttacgatgcggacttgaaacgccaaggcgaattacaggcagcagctaccgaaattgaagcacaactcacgcagttaaaagcggacctggatgcggccaatgaacaactacaacattttgatcaaagccaagaacagattcgccaacaacaaaccgctttggaaacgaagttggcagttgcgcagtccgaacaaaaaaatgtacaagaaaaacttactgatgccacgcaattggctaacgatttaacgcaacaactcgaaacgagccaacaagcgctcgcagcattgcaacaagctgattctgaagatgcgatgacgcaaaaagaacggcggacgcaactgaagaccactaaagcactaatccaaaaacttactgccgaattggcaacaaaacggacggcgcgagaaacgctgaaggccacgcaacaaacgttacaagctaacgcaacgcgtgtctaccaattgcaacggaattctttagctgagcaagaacaaaacgcggttgctttaaaccgtgttaagattaatattgaccaacgcttaacgacattgcgcgaagattatcagttgagttatgaagcggctaaatcggctttacaagcttccgatttaacgaatgaccaattgaagtcaaaactcaaacttttgaaattaggcttagctgatttagggactgtcaatttagcggctattgaggattatcaacgggttaaggaacgttacgatttcttaatgcaacaagatgccgatttattggacgccaagtcacaattattagcgtcgatggctgaaatggatgcagaagttgaaaaacgcttcaagcaaacgtttgaccaaaccgcagcggcctttgaagaaatcttcccaatgatgtttggcggtgggcacgcgtcattaaccttgacggatccatctgctttattaaccagtgggattgatatcattgcacaaccacctggcaaaaaactacaacgccttagcctgttatcaggtggcgagcgcgcattaacggcgattacgttgttatttgccattttaaaagtgcggcccgtaccgttttgtattttggacgaagtggaagcgtcattggatgaagccaatgtcgatcgcttcggtcgttttatgaaacgctatgagagtgagacgcaatttatcgttattacgcatcgcaagggcaccatgacccaagccaaccggttatacggggtaacaatggcagaatcaggcatctcgaagatcgtatccgtctcgttagaagaacacgaaaccgcctagatgggattatttgatcgcattaaaaaagcattcacgttagaaccagaaaaagaaccggaaaacgtcgacgaacaagcaacgactgctgaaaaggaagctgacgatccagctgaaaaatcgacagaaaagcttgacgattcaaccggcgagaccgattctggagaaacaccagaaacaccagaaacaccagaaacaccagaaacaccagaaacaccagaaacaccagaaacaccagaaacaccagaaacaccagaaacaccagaaacaccagaaacaccagaaacaccagaaacaccagaaacaccagtcgaagaaccaactgaaccagtggtcgcagaaacaccaacaccagttgaaccagaaccggaagttgctgaacctgaagcaacagcagcgcctgaagaggcagttattgttactgatgaaccagcagtttcagaagaagcaacggtggcagacgatgcggaagccgaaccggttcaagcagctcaaactgaaaaatatgatcaaggtttagaaaaatcacggaagacttttggacaacggttgaacgccttgttcgctaacttcagaagtgtcgatgaatctttctttgacgacgttgaagaaatgttaatcgaagccgatgttggttatgaaacagcaatgaaaattgcagacgaattacgtgaagaagtgaagttacgcaacgttaagaaaccagaagccgtttcacaagcgattgttgaaaaattagtcgatttatacggtcaagaaggacaacaagaagataatgaattacatttcgccccagaaggtgaattgacagtctttcttttcgtcggcgttaacggtgccggcaagacaacttcaatcgggaagtttgctcaccaactggaaaaagccggtaagaaggtcttacttgccgctggtgatacgtttagagcgggtgcaatcgaacagttgcaagaatggggccgccgcgtttctgtaccagtggtcgctaataaagcaggcagtgatccagccgccgttgcttttgatgccgttaagcgggctaaagaagaaaactttgacgtcttattagttgatacggctggtcgtttgcaaaataacgtcaacttgatgaaggaacttgaaaaggtgaaacgcgtgattacgcgtgaaatcccaagcgcccctcaagaggtcttgttagtattagacgcaacgactgggcaaaacgccttggttcaagctaaacaatttaaatcaaccactgacgtcaccggaattgtgttaacaaaactggacggctctgctaaaggtgggattgtccttgctgttcggacagagctacacttgccagttaagatggttggtctaggtgaacaaatgaatgacttacaattattcgatcctaaccgctttgtttacggtttattcaaagacattattgtcggggatggcccacaaagtgagattgatacggatgttagtcaggcgattaaatgaatgaaatttataacttctgataaagtgtcacttgattattcagatgttggtgtagggcaaccaatcgtttttctagccggctttggcgcttccaaagaaatttggcatgcgcaagcaattttctttgaggctcgtcaatttcgagttattcagctagacgtccgtaatcaaggcttagcgcagcatacggtaaaaggattaagaatgtcacgaatggcaaaagatattgcggaattaattgcatcacttggattagtcaaaccaatcttagttggtaattcaatgggtgccgcttgtatctgggcttatatgtcactttattctgatcaacaattggctaaagtggttgttgtcgaccagtcacctaagatgattgctgatgaaacttggcattatggttttaaggacttagattggaccaattttccaatacaactcagattagactttggtcgtgcaacctatcggaagattgatacagcgactaacgaattggtaactgcaattaaacagcaacaaccatttgatagagaacttgatttaccgttattggtggatcatgcatttcaggattggcgggatgtcattcgacagagtacgcggccatatttggtaatcgcaggtaagaaaagcccttattttaatccagaatttgccgaagcagtggctcaaatgggtgccgatggtcactttgagataatcgaagaagccggacatattgtgatggctgaacaatctggcttgtttaatcaggtactattaacgtttattgaagcttaattaaacgtttgacgctaaaatcttagttgctgtgggttcatcaagaataacgtctgttaaaaaattgcctcgtaatgcggcagcaacagcgtaactcttgaatttattattaacaacggcaactcggatagggactttgagaatatcgtcgattgaaatgccaaaggttttatcagcgctagaatcgattaagaggtggccatcttgatcgaatggtcggccataaagtaacccaacaacctgttttgccttgatattagggaataaagcggctagactatcatgccaactaggaatcgattctaaggactccattgttcctaaagtagttagaatgagatccatttgatgtgctgttgttaaggttggctggattgcaggttcaagtgctagtaattggcgaacttgatcattaagaatgtagaggggggcgtttaatgttgagtattgactattatatttattggccgctttttgaaccatccgcattgagccggcaagtgagttgtatttaccgttttcacccatgaattgcgtgaaaataagttgttccttggttgttggtttaaaccgttcgataacgttataaacagtgtctccccaacttagcccaataatttttaaaggttcgatgagactttggacattttgggctgcgaaggcgtaaaagcggtcggcatcattgctatttttttcagtgttagcaagtacgtaaaagtggtggccgggatagctaaccccaagttgtttttcaagctcctgattgcgagcaaaaggtgacctaattgtaattgaaacaatgtttttagttaatgcttcatctaaatattttgaaattttgtaacgactaacttgatatttagttgaaatgtcagcaattgttaattgattgatgtagaaatcttgcgcaatattgatcaataaatcagtatttgtttgttcggccatatggctcttgatgagataaaagcgttgcacgagaagcatacaggcgttttaagtatttatggtgaactgcctgtgaaaaatagaacagatttaggtaaagcatatacacccggtgttgccggattaagtaaattaattcaacaagatccatccctcgcacgccaatatacggttagtggtaagttaattgcaattattacagatggttccgcagtgcttgggttgggcgatattggtccccaaggtggcttaccagtcgttgaaggaaaagcactattatataaggaattagcgggtgtcgatgcgattccacttgcattggatcaaacatcggttccagaattcgttcaaacgattaagaatatcagtaaaagtttcgctggtattcatttggaagatatcaaggcacctagatgttttgaaattgaggatcaattgaatcaagtgctcgatattccagtatatcatgatgatcaagagggaacagcgattgttgtcttagcgggcttgattaacgctgctaaagttgttggcaaatcattgactgatttaaaggtcgttgttaatggtgcgggcgcttcaggactagcaacagcaaagctattggctaatgtaggcattcaaaacattacactagtcgatcaaaaaggtgtggttcgtgatcaaagtactagtctaaatgattatcaattgaagtttgttcaatcagttcaaccaaacacagatgcgcatacgctagcagaagcgttagttgatcaagatgcattgattggtttatcagttggggaaatcgtaaccgaagcaatggttaaatcaatggcgactgatcccattatttttgcattagccaatccaattcctgaaatcaatccggcattagcgcaaaaagcgggcgctgcagtgattgcgaccgggagctcagcctatccaaatcaagttaataatattctagcatttccaggactcttcagaggcttacttgagaaccatgtaaaccactttgaaactggtatggaagccgagattgcaaaagccttagctaatatgattaaagcgccaactaatgaaaagatagtacccggtgtctttgatgatggtgtcgttgaaacagttgttgaagcagtaaagcagtataaataaatggaagcaaagaaaactgtaaacaatcagaatttatttcaaaaatttattgcattacacattggtattattccgatgccactctatttaatcttaacacttggctacgtcctattaacaatgggaaatcaaatgccagatgatatgttaggtgctttaggcatcatgactttattttcatttattctggaagaagttggtaaacacattccggtcttgaaatcattaggcgggaaagtgttggtggttaccttcttaccatcatatttagtttatcagaattggttacctaagagtactgttcatgttgtaacgaattttatgacgcgcaacaatttcttagcatttttcattgctttattaattgtcggtagtatcagtgcgatgaatcgtaaaactttgattaaggccagtaccagaattattgtcgttttattaatttgtgaacttgttggtccgatattgggaatcgcagttggaacattattaggcctttctgcatggaagagttatttctatgttattgcaccaattatggccggtggcgttggtgaaggtgctttgccactatcattaggttacgcagctattatttcaatgacgcaacccaagatttttgccatgattttaccttgtgttatgttaggtagtttagtagcagttatcttagcgggtattttgaaaaaaatcggtgatgtgcacccagaattaaccgggaacggccgtcttgttgaatcggatgaagctgaatcagggcttgataatttaacacaaaaatcaaacggtgctgatatcgaaaaaatgttggtatcaggtattttagcaattgcgctttatttattaggagtttgggtcaatagtgttattcatttaccagcaccaattgttttattaattgttgtgatggctgctaaaatgttgggttggattccggcaagcttacaagctggtgggagttcattgtatagtttaacggttaaaggcatcacaccgccattattatttggtgttggggttgcaatgacaccttggaaatcattgattacggtctttacgaacgtaccaatgttgatcacaattgttgtgacagttaccggaattgtcgctgctgctttctttagtgctaaattcttgggaatgtatcctgttgatacggcaatcgcggtatcatgttgtagtggtcaaggcggaaccggtgctttagcgattttggcagctggtgatcggatggtcttaatgccatttgcacaagtggctgttcgtttaggcggtgccattaccgtaacattatcaatattcttgatgcgattatttgcttaaatgaattactctcaacaacttaaacaattgaacttgaaagagccgcattactataaacaatgggccgctttactcacacaagagggtatcgaaggcttaccacaagcacctgttgatgtcgacggctgtcttggcatttttgaagaccaacgactgattgctactggtgcgtatcaaaaaaatgttttaaaatatattgctgttgatgcgaactatcaaggcggtaagttgttcaacgacattatttcggcgctgatcaatacattaacgcagcaaggggtttttcatttctttgtttttacaaagccgatttatcgacaaagctttgaattcgtaggctttaaacttttggctcaaacttccttagccgtattattggaagccggagatgcctccttacaacaatttattgcacaggtaccacgtcttgaaaatcaatctactgcaacgattagtgcgattgtgatgaatgccaatccatttacgttggggcatcgctatttggttacacaggccgctcaaaagagtgattttgtctacgttttcgtcgttagtcaggatgtgtcactttttacaactgaagaacggtttaaattggttcaacaaggtctctctgatttgccaaatgtaatcgtggtacaaagtagtgattatatggttagttacgcaacattcccctcatattttttaccagagtcacaagatataattgaatatcaaactgctttggatgcacagttgtttaaaaaaattgccgcgcagttgaatattcagcaacgtttcttaggggaagaaccattttctaaaacaacggcactttacaatcaagcgttgaaagctactttaccgccagagataaccgttgaagtaattccaaggctgaaagcagcaacacaaactatttcagcgacacaagttagaaaagccattcaaaatggcacaattgaaacaatccatacgtttgtaccagaaacgacgtatcaatttattaaacaaaatcaggctattttacaagccagaattcagaaagggatgcaagttgatggaaattaaatggaaattaaacatacagcaattgcaggcacactagaatcaagtgatattcaaatcatgctttctaaaattgaaggaccaactgaaattgaattagaaagtgctgttgaaaaacaatttgggacacaaattcgaactttaatgcaaacaatcctagatcaatatggacttacaaacgttaagattaaagcagtcgataaaggggctttagattgtacgattaaagcacgcttaatcacagttattcaacgagcaaccgacaaacaaaatgatccagattgggaggtattaggctaaatggaacgtttacgacggacgatgatgtttgtaccaggtaataaccctggtatgttgaaggatgcagggatttatggcgccgattcagtcatgtttgatttagaagactcagtatcacttgctgaaaaagacgccgctagaatgctagtgatgcaagctttgcaaacagttgattatggtgatacagaattagttgtcagaattaatggcttggaaacaccatttggccgacctgatatcttcgcaatggttaaagctggcgtgaacgttattcgtttaccaaaaactgaaacagttgatgatgtcttggaaacagaagcagtgattgcagaagctgaagcttattttaatatcccaattaaaacaactaagatgatggcagccattgaaagtgctgaaggtgttttaaatgcacccgcaattgcaaaagcctcagatcgtttaatcggtattgcgattggtgctgaagattatgttacaaatatgaagacacaccgttatcctgatggggcagaattatcatttgctcggaatatgattttacatggcgctagagctgctggtattgccgcttttgatactgtttattcagatgtcgacaacgaagccggttttaatcacgaagttgagttaattcatgaacttggttttgatggtaagtcagttattaatccgcgccaaattccattagttaatgcaatttatgcaccaactgaaaaagatgtccaaaatgcaaaagatgttttaaatgccattgaagaagcgcggattaagggttcaggtgttattgccctgaacggtaagatggttgataaaccggttgttgctcgcgcacaacggacgatgatgttagcagaagcatcacacttagttgatcaggagggaaattggcatgctgaataaatgctgaataatgtacaacgagaattaccagatgaattaatgaagaaaacgggttatcaaccatttgaaactgttgaaattgggcatcccgaaattcaacgtgtggcgcctaaagtaacggttgatcaaggtcacgctaaattagtgtcgtcaattgaagacgtcataaaaaaggttggtctcaaagatggtatgactatttcattccatcatcatttccgtgaaggggactatgtctttaatgcagttatgcaaatcttgattgatcaagggtttaaagacttaactctagcaccaagttcattgacaaatgtgatgaataagatggttgttaaagcgattaaggcgggtgttgtaacacatattacatcatctgggatgcgtggcgaattaggtgatttagtctcacatggtggcttagaaaatcctgttattttacgttcacatggtaaccgtgcacgagccatcgaaagtggtgatatcaaaatcgatgttgctttcttaggtgttcctaattctgatgaagtcggtaatgcaaatgcgattaaaggcgatgctgtttttggttcattaggttatgctttaatggatgcacagtatgcagataaggtcattttattaactgacacgattatgccatatcccaacacaccagctagcatcaaacaaacgcaagttgattacgtggtaaaagtcgacaaggttggcgatccggagaaaattggttcaggcgcaacacgctttactaaagatcctaaggaattaaaaatcgctgaaatggtaaatgctgttattacacattccccttatttcaaacaaggtttctcattccaaacaggttcaggcggtgctgcattagctgttacacgttatttacgtgaatcaatgttgaaaaaatcaatcacagcttcatttgctttaggtggcattaccaaacctaccgttgatttattaaacgaaggcctagttgacaaaattttagatgttcaagattttgataagggtgctgctgatagtatggctactaccgaaaatcaacaagaaattgatgcttcttggtatgcagatcctaacaacaagggtgcagcggtgaaccaactagatgtctgcattttatcagcgcttgaaatcgatacgaaatataacgttaatgttatgactggctcagacggtgttttacgtggggcaatcggtggtcatcaagatgctgctaatgctaagttaacgattatttcagcaccaattgtcagaggtcggattgcaacggttgttgatgatgtgacgacagttgttacacctggtgattcaattgatgttttagtgacagaattagggattgcgattaatcctaaacggaaagatttacttgaagcactagctaatattcctggtgtaccagtatttacgattgaagaacttcgtcaaaaagctgctaaaattgtcggtcaagcggcgccattagcattcacagataagccagttgctttgattgaatatcgtgatggcactttaatggatgtcgtttaccaagtgaaggactagatgcttaatctatttgcaacaggaatcccgcaagagattaccgcagtattaaataatcgagatcaacgagttgaattacaaaatcaattagttgcagatgctagtcaaacgcagagtgttgttgctttaaaactcaatattccaggacctattaagaataatgctgacttaacacgtttattcttggcaggactagctgcttttaaacaaaagctagttgttgttcgacaaatagattggtcgaaatcaactggcccagagacctttttaatcgtagaagggtcgtccttggctattaaaaaacaagcggcaatattcgaggatcgacatgctttagggcgattatttgatattgatgttttgatttggcaatcagatttacaacaagtgcagccgataagtcgacaagcattaggacaaccaacacggcgctgtttattatgcgaacaacctactaaagtttgtgctagaagtcgccgtcatacggtggcggaattacaagcggcgattaaccaacaatatcaattatttatggagactgattagatgaaaacaccccaagaaatcgcgcaacttgcgcagcgcgctcttttatacgaagtgagttgttatcccaaaccagggttggtggatccaattgatcacaaaacacatatggatatggatttctttacattcattgatagtagtgtcgtgttattacctttttttgaacaatttgttcgcgtaggcgcaacatttaatcaggctgatttaacgtcattaatgacacaaattcggccattagggattcaggctgaagaagcgatgcgccaagcgactaaaggggttaacacgcataaaggcgcgattttctcactggggattttattgagtgcaacaggctatctgcaacaaaaggacgcattagccgcaacagcactcagccaaatggttcaaaagatgttggctggattagtgaagaatgatttcaaaacacttcaccaaaaatcgccagcacaacttaccaatggtgaaaaaatgtatcttaagtacggtctagttggcattcgtggtgaagcacaagctggctatccaacgatttttgaagcagcctacccttatttgcgaaaacaaactggtaattggaatacacgcttattgaatacattgatgaaaatcatcagtgtttcggaagattccaacttagtgaagcgaagtggtcgtttacagacactaaaagatgttcaggcacaagcagctgcgattgttgcagctgggggtgtcaaaacatcaatagggcaagaaggcctgctaaacttggatcaggaggcgactcaagggcattatagccttggtggcagtgctgatttattaataattacggtctacgttacattgttactacaatagatgcgggccgggtttgaaaaagtttttccaaaagcaacttatgttgaagttcccatggcagatggcggcgagggaactgtgcaatcgatggttgatgccacaggcggtcggtttctaacggctgaagtcgtgaatcctttaggacaaaaagttactgcgcaatatggaattctaggcgatcaagaaacagcggtcattgaaatggccgctgccagtgggattcaattcattaatgaacaaacacgcaatccgttgttaacgacgacatacggcacgggtcagttgattgaagcggctgttaaacagggtgttaaaacgattattatcggtcttggcggtagtgccaccaatgacggtggtgccggaatggcgcaagccctcggcgttcaattattgaatgccgaccagcgagccttagcgtttggtggcggtgctttggctgacttagcaagcatcgatgcaactaggatgttaccagccttagcggacgttaaaatcgtcattgcgtcggacgttactaatcctttaatcggtgaaaaaggtgcctcagccgtctttggtccgcaaaaaggggcgacacctgaaatggttgcacagttggatcaaaacttagcgcactacgcggccattatcgagcgtgatttaggcgtcagtgttgcgcaaacaccaggtgccggtgcggctggtggcttgggggctggtttgttaggctttacgaaggcacaattacagccaggcgttgaaattgtgattgaaaaaacgcaactcaaaacggctgttgcagacgccgatatcgtcatcactggtgaaggtgggatcgatttccaaacgcaatatgggaaaaccccgattggtgtcgcgcaagcggtcaaagcggttaatccgcaagcaaccgtgattgcgattgccggtaatatcggtgaaggaactgacgtactctatgatttaggcattgatagtatcttttgttcaacaccgggggtcatgtcattggaaaaagcgttggctaataccaaggctaatttaacccaaacaagtatgaatatcgcacgcttaattcaaaaaacaaagacacactagatggaactcgcacaaaacgcacgaatgaattcactatttgaattttatggcgcacttttaacggcgaaacaacatagttatctctcattatattatggcgatgatttctcattaggcgaaattgccgaagagtatcaagtcagtcgacaagcggtttatgataatatccgccggactgaaaaaattcttgagggctatgaggctaagttgcatctgtttcaaaattacgaacagcaaaacgctagtgcagacgcgctccagaagtatattcaagctcagtatccaaatgatcagcaattagccaaactcttggcagacttgctgaatctcactgaacaataaatggcatttgaaggactaacagaaagattacaaggtgcattaagtaaattacgtcgtaaagggaaggttactgaagctgacgtcaaccaagcgatgcgtgaaattcgcttagcgttattagaagccgatgttaactttaaagtggttaaagacttcattaaagtcgttaaggaaaaggcaatcggaacggaagtgttggagagtctctcaccagcacaacaaatcgttaagattgttgatgaagaattaaccaagatgatgggtgaaacggctgtaccgttgaacaaatcaccaaaaattccaacgattattatgatggtcgggcttcaaggggccgggaaaaccacgactgccgggaaattagccacttatttaattaagaacgaaaaagcacggccattgatgattgcggccgatatttatcgtccagccgctatcgatcaattgaagacggttggggaacaagttggggccccagtctttgaaatgggtacggatgttaatccggttgaaatcgtacgccaagggttggcacaagctgctttacaaaagaacgactacgtcttaattgatacggccggtcgtttacaaattgatgaagcgctaatgcaagaattggctgatatcaacgatttagcccatcctaatgaaatcttgttaacagttgatgcgatgactgggcaagctgcggttgacgttgctgaaggctttaacagccgcttagacatcaccggggttgtcttaactaaattagacggtgacacacgtggtggggctgccctttcaattcgtgcggtaactggcaagccaatcaagttcactggtcaaggtgaaaaattaaaccaattagatgtcttctatcctgatcggatgagtagccgaatcttaggaatgggcgacatgttgagcttgattgaaaaggctcaagaagattacgatgaacaaaaagcggttgatatggccgaaaaaatcaaagaaaatagctttgattttaacgatttcctcgatcaaatggatcaattgcaaaatatgggaccattggaagatatcatgaagatgattccggggatggctaataacccccaacttaaaaatatcaagatggatcctaaggatatgacccacatgaaggcgattgtgcaatcaatgacaccgcaagaacgggaaaatccagacttattaaacccaagtcgtcgtcgtcgtttagccgccggtgctggccggccaatcgttgaagttaatcggatgatcaaacagtttaatcaatccaagaagatgatgaaccaaatgtcaaaaggtaactttaatggcatggaaggtttaatgggcaacggcatcaagggtaaaatgggtaagatggccatgaactcaatgatgaagaagcaaaagaagaacaagaaaaaacgtcttaagaacgcacgtcgttttaaatcttaaatgtcagttaaaattcgtatgaaacgtatgggttctaaaaaacgcccattctaccgtatcgttgttgcagattcacgttcaccacgtgatggtcgctttatccaacaagtaggttactacaatccattaacagaacctgttgacttgaagttagaagaagaagttatcatggactggttacaaaaaggcgcacaaccttctgatacagtacgtaatcttttatcaaaacaagggattatgcaaaaatatcacgaagctcgcttcgctaaaaagtagatgacagacgtgaaagaactaattattgcaattgttcagccacttgtcgaacatcccaatgatgtcaaattgactgaacatgagacggaacgttttatggaatttgacttacaggttaatccatcagatatcggacgtattattggtaagcaaggccgggtagcgcagtcaatccggaccattgtctatagtgtgaaaacaccttatcaaaaacgcgttcgcttaaatattgtagatgcctaaatgccagaaaaatactatcaagtcggtaaaattgtgaatacgcatggtattcgtggtgaagtccgcgtcattgcgacaaccgattttacagaagaacggtttaaaaagggaacgcacttggcggttgaaatgccaaatggcttaacaccagtgacggtttctgcgatgcgtcaacataagcaattttacttattacaattcgaaggcttaggaaacattaacgacgtcgaattatttaagggacacaacctcaaaattgcggcaagtgaacgtgatgatcaacttgaagacgatgaatattactacggcgatatcattggtttagaagtgattgaagaatctgatgggacaagctatggtaaggtctcagaaataatcgatcccggtcctaatgacgtgtgggttatcaaacgtcgcggccgttctgatttattactaccatttttgaagtcagtcattaaaaaaattgatattgaagcgggtaaggcctacgttgaagtaccagaaggattgattgataatgaagattgaatgaagattgatgttttaagtttattcccagatatggttcaaaatggtttatcgcaatcaattatcggtaaggccatcgatcgagatttaattgatctagaagtcactgatttccgtgatttttcagtcaataaacataattcggtggatgatgcgccttatggtggtggtgcggggatgttactccggccacaacctatttttgaagcgatggaccaagtgaacgctaaaaatcccggccataaacgcgttattttattagatcccgctggtgttacttttaatcaaaaggttgccgaagaattcgcacaagaagatcacctcgtattcatctgtggccattatgagggctatgacgaacgaattcggaccttggtgaccgatgaagtctcattaggcgattttgtcgtcacagggggcgaattaggcgctatggtgatgattgatgccatttcacgattagtgcctggtgttttaggtaacgaacaatcagccgtcacagattcgttctcaacgggcttgttggaacacccccaatacacacgaccaccagaatatcgcggcttaaaagtaccagaagtattgatgaacggtaaccataagctcattaatcaatggcgggacaagatgtctttgaaacggacttatgaacgccggccagatttattggaaaactttgatctaaccgcagatcaacaaaaatggttacgtgaaattaaacaagaggccgctgaaaaataaatgaatctattaattcaagaaattactaagtcacaattacgttcagatatgcctaacttccgtcctggtgacagcgtacgtgttcacgtgcgtgttgttgaaggtactcgcgaacgtatccaattattcgaaggtgttgttattaaacgtcacggtgttggcgttagtgaaacttatactgttcgtaagatcagtagcggtgttggtgtggaaagaactttcccattacactcacctcgtgttgctaaattagaagttactcgtcatggccgtgtacgtcgtgctaagttatactacttacgcgcattacgtggtaaggcagctcgtatcaaagaagctcgtcgttaaatgaaccattggatttatattgtcatgtatcaagcaaacccactctattatgagaagagtaagatgatccgcgcgtttagctcggaacaacgggctaaggaatacgtttcgctattaaatgaaacgccctatgccaaccaatctttaaaagagggccattacacctatcagaagttgagtctcaactaattagggccacggtgcacggtgtgtttcaaaactaacccggctttgagtctgattgcgcgcgatgcctctatcgaataagtaagggcttacaaaagggagcgcaaataaacagatgagatttaaaataacaaaataccgtttcatttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacaacgactgttaatgaagcactaactaagttcctaaccacttttaatggtccggtgcacagctttactgtggaccgtggcactgagtttagtgggctagtatcacttgaatcacaatatggtattaagacctattactgccatgcttatactccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaattaattacgagtgatatatgatttgagtgccagtactaaaccggcgaataagaaaataatagcgagtaataaataattaggaatgataattaacgttaaataacctaagatcgccagtaagttagtgaaaagtgcgatattttgttctaatgacaacaagtaggcgatgacatgcaaaagaatcgccaccaaggctaaccaccaaaccttaccgatagcgtccatataggtcggtaagaaattagaaaatggtggattcaggatcaaaattaaagccgattggaacagcgtcacgactaaaaaaataaaatcaaagaagaaaggaaacttgtaaggtgatattttcatatgagtttaaaagttgaaatggagatgaaggcaatgttagtcattaaatatgtaaatggtcaaaatagtgccgaaaaaatttatcaaaaagctgctgagtttgtggcaaatcaacaactagaagtgccagactttgaagactatgttcaaattgcggaagtcacattggatggtaaaccattgacattagacgatgcaaccatgcgtgggctatataattatttaaaccaataattagtcaaagttaacatccagggcatattttaatttatctttttgattcgatgttattaaattgattgtgtaagcatacttaaaaatacgattagcgtatttatctgcccaacgattaacaattggttgtaatagcttaggcgtaatttcatttagtgggatggatccaatttctggtaagatgtgacaatcaaaaatctgcttagttttgtagattgtactagattggacggtagttcggtaagattcactaaaccactttaaataagcttgatgaaaggtaagagcaggagaatcagttaatttaaatacatacttatcattcttaacccgagcttctattttacgaaattcagcattagctgcagcgggtgttttaaaccctcgacgagtgataactgattttttatgggtctcgggattaataccaacataaattctaaacaggtatcttctttcgcctttgctaatatattctgtaatagcgttatttttatcatacttaaacatttatttaatagataatttatcttttacttcattcttattctgaaaatcaataacatcaatttcgtgagacaaaagtccatcaatgaatggtttttctttatcggatataccatttataagaatattgaatgaggagttagtgccatagttattctctctgaacccggaagtgtcactccaaataccgataattgcttccatagaatttttggatagggtattgtacattttagttagtttaaattcatttggttttggagtgaacaagtattcaaatttatatttttggcttgttttaccatcagcataaatagtatttaaaaaactataatcagatcttctttcattaaaataatctctaacatcatcaaaaaaaacactagcagtattagttctgttcataaacgcaatatcagaaacatttattaaaacctgaataaaatctgttatcgtttgagatagttcgctctttttaactaacttaaagatagtatcattctttccaattttaaagttatagggggtaataatagaaagcagtattcgccatctattagattgctttgatttcacattaataccattagaagtaagattccagatggtataaccctcgtcagtaacttgataaatgtcattttctttcgaaataatattaaatagaataccatcaccgaaattatctacaaaaggtgtaataacttgtattttattattatctagtcttttgaaatttgtttgcccggtcatccaagaagaccagttgtttgcgatgctttttatttctaaatcctgagtatccatttaaaagtttaatggttgcggaattgttaattgaagtttatcacggttgctggtattagtatagttaaaaaggtcgtctattgcttctagaatatccctagtatttcttaaaacgcccttgggaagaggggatgcttttgtatgggttgttccatctccttttgaataaaattcatcctccgaaaatatattaactctgtttccgtatatcttttcgccagtagaatttttatgaaaactatcatttaaattcattctgataagagttaattttgttttttcatccataaattgtagatgaatattgttgcttgaatagaagtaccgtaaagaaaatttccttccagaatttgaggaaatgttaactattccgcgatcgccatctgttaggattctagttgttttttgtgttaatttttttagggatgcaattaaatcatcagcttcgtgttgagttagtagtagttccatttagtctaaattaatagttaaatcatagttatgattagaattttcatcttcgtaatcatcagtatcatagctagcattaaacttatatcttaaagatttaatatcggaaatattatttagtttttctagtgggaaaatgacgtcacccgatttattggctccgttagcgatatctccaccccaattagttgttacacccttcatagaaggcataatagcctcctgctgttgtccgtcgtttgtaatgatagttccttgatcagggaatgtagcagttaaatcacgagaaggcttaactgctacatttagaataattaaaccttcagcctttttaccggattctgaattgtattcaaaaggttttactttaatgactcttgcgcttgaaatagaaacagaagccgagttccaagtagtgtcagatacggaaagtttgtaagtcttttccgaaataataggaaccttgttatagtcaatcgttaaactattagaattatcggttctatttttagaatttcctttttcagcagaagttgttgtgtgagctgttgcatttgattctttagtatcatcgctaccccctgaaagtgctgcgaaaataaatataataacgacaactgctagaacccagatccaccagcgcttatacaaaggtttaacttctacaaaagtattcccgttttcatcttgaattttttttgacatttattttctaataagtgcaagaattcctgcgacaattattaatactccgcttaaaacaccaaatgctgaaacaaaaacaatatttaaaatgccacagacaatgattaaccaacccatcacaacgcgatttttattaatcatacatactaaaataattgcaacgatgcttgcgacaacacaaccgaagcccaatccaaacaagctacttgatgaagtattgttgattgcactgtcaaaaccacccattaagaacgaaaagacaccagcgataatcccaaatacgccacccatgattcccaaaatcatttcagctgtacgtgaatgttggctttcttgattctcgctgacttgtttgtaaactttaccgtctgcacctttaattttagtgctcatgtgaacaaacatttttatgggaaatacgagattaccgaagcgcaagatgagggacagtatgttgcaacgatcaaactacgtcagtcgattaagaaggtagtggtaaaatccgatgcactaacaactttagcgcaagcgggtgtgaccccacaaacggtcattcacaatattgtgaagacgccaaccttgttgaaggataaggtgattgtttctaatcacaacttagcaggctatttagattaattagtcttcgctaatatctgcgaaagtgcctgagaccacccggctcaggtcttgggggttaatctggattgaacggccaattttacctgatgaaacaaagattaaaggttctttttcggcttgttggtcgatatagattggaaaatgtgctttttcccaaataccaacgggcgtattggcgccatgttcgtacccggttgttgctacgagatcctttaaagggaccatcgcgatttttttattaccggaaatcttgctgagtttcttttcgtccaaatgacaatcgatggggacgacaccgacaattgggccggtttgtttgcccgagagcacgagtgttttatagatgagatgttcatcaatatccaagtgatcgacctgcatttgtgcgacgtgatgttcttcgtgtgttggaaactcaaattgtgtataggcgaccttttgtttgtctaatattttttcgacaagggtctttgcgagttgtccttgttttttctttttacccaaatgttgaataggggtataatgactttaaataaggagttgattgtgatgaaatggtttagaaaacggcaagaaacagtaagtggtgttcaagcacatgattttacgcaattggtcagtcaagcaagggataacgatgcgcattatcagaagattcgggtggccttttcggggttaaccaaaccatatcagcaaccaattcacaaaaaatagatgacaaccaagacaataccggctgtaagctatgtggttcaggtgaaccaactgctcgaaagattcgttgtatttgaaacggtgtttttcgagtgtacgcaaacttgtaggaatattattttaggaagatgcacagtcggtgaaacgttagcgaccctggatcattacgttgaccaaaatttaacggtcctgcgggcatttgttactcaagtcgctgcggtgcaaccaccaactgcgtttgtcacgattaatcagcaattaattacggcacttgaacactacgttgatgcaacagaaacgatggttcattcttttgaagggccttctaaagaagtttatgcgcaagttttagcggcgcgtcatgatcaagaaacacaacgtgaacaaattaacacagttttacatgcgatttctatggttagtttttcaaccgctgatatggcataaatgaatagacagacttggcattttcttttttataaatcaggctttaccaaagaacagattgatcagttactagcctatttaggacagcgacagaatttcggcggttttccacttgtttcactcacgcaagatggtgatagcaacgagattcggttcgtaacgatggtctttgatcctttgtcagagattatcccatcggttcaagaagaaatggcgaagtttattttaatgcacgcgattcgaccagtggataatacggaagaagctgatatgcgtttatacgggcgggttatgagtcactcgcttgaagatttaggcattgaatttcaccgttatgatgctaatacaatggatattaattattggggccaaaaaaaggccgactaaatggtcgaaaaaaacatgttagaattttttgaagcagaattagatgatttacaatttagcggcgatatcaacatcaactgggataaacaatcacgggcgatcgaattagaattcacgttaaatgtgacgaagagccaagaattggctgtcgaagatcaaaatggcgaattaaatgaatcagatgaaattagttatgaagatgcaattttattcttcgatgaaagcaaaatcgacggttttgaatatgctgataactatttagctgtcattccattttctggccgccaaggtttgaatgcccaagttgggcgtggtgttttcaattatctccaagacctattagatgacggcgaagatcacttagctgcctttgtaaacgatgaatcagatgacgaaacatttatcttggactgggatgacacggttttccaagcaaccgttgcccaagccagtgatgacttagctaaaaaatactacacttaccctaaatactaaatggaatggacaaaagtcacagttgcaactgtcaatgaagcagttgaagcgatcgcaaatattttaaccgaagctggcgccgagggcattcaaatcgaagacgcctcaattaacgatactttagtcggggatgtggcagcagtcagtgcctttttcccagaaacggtttttgttcctgaaaagttaccgttgattcgtcaatgcgtgttacaactcacggaattcggcttagcaattggtgaaggtagcgttaatctacaacaagtggccgatgatgattgggcaactgcatggaaaaagtattatcaaccaacccgtctaacccgtttcttaacggttgtgcccagttggacggattatcaaccaacagatgaacgtgaagctttaatccgaatggatccaggaatggcttttgggactgggacgcatcctacgacgcatctttcagtacaaatgctagaaatggttttacgcagcggtgaacaattgatcgacgttgggacaggttctggtgtcttgagtattgcggcagctcatttaggtgttcaagatattcgcgcgtatgatgtggatcaagtcgcagtggatgctgcggtcgcaaatttcgatttgaatcccgttacacaaggcatcattgccaaaccaaacgatttattacacggcattactggtgcggctgacgtaatcgtcgccaatatgttaccagtggtcttagtgcccctgattccacaagtgccggccttattaaaagaaggcggccacttattattggctgggattatcactgaaaaagaagcagtcattcgcgaaacgttgagcgctaacggcttaatggttgaagaaagccttcatatgggtgattgggtcggcttgattacgcggctaaagacggacgaagattagatgcaacgttattttattgaagaaaccgtgaaggttgatcaatcattacaattaaccggtgaaacggcgcatcatatgctcaaggtgatgcgtatgcaagttggcgatcagattgaaatcgtgacgccagaagaattagcttttatcgcacaattgcaatcagcagatgcgacgcaaaaacaagcgactgtgacagttgaatcagccgtggaaacagatgttgagctgccgattgaaacgacgattgtctgtggcctttctaaaggtgataagaccgattggatcgttcaaaaggggacgcaattaggcacacatcgctttatcttttgtaatagtcaattttcagtagcgcgttgggatgctaaaaagcaggtgaagaaactagcgcgtctgcaaaagattgcccaagaagcggctgaacaagcgcatagaacccatgtgccagtgattgaatggcgcgcgagtttaacggcaattgctgaagaatcagcggacattaaattagtggcgtacgaagaatcagcaaaagccggtgaacacggccaattggttcaaagcctacaatcagcgcaaccagggcaaagtttaatctgtgtttttgggccagaaggtggcattgcaccaaaggaaattgaggccttacaagcagcaggtttcttgttagctggtttgggaccacgaattttacgggccgaaacagcaccgctatatctactaagcgcaatttcatatgtgacagaattgagtactttatagatggataaaattaaaaataatcgctttttaaagcaagtttgggtccgttacttcttagtagcgttactccttgccgttgtattgccactcgttttcggttggttatcaattagtaaaacgtggcgcattgggttgctgtttatggcaattaatggctgtgcagcctttttcatcggctatcgcattcagaaaacacacgccccttggtataatattttttatctgccagttttatttgccttaatggttgttgtccgcttcgcagattataattattggtttatcccaatttacttcttattaagttatttgggtattaatactgcgtacgaacgtcgcaaataaatgtcagaagaaaaagtgatttcacagcaagaagtgatccagctatgtcagaaatacatgaatgctgagcatcttgctttcgtgcaaaaggcgtatgattttgcagcgtatgtgcataaggaacaagtacgtcaatcaggtgaaccgtacattattcatccgattcaagtcgcaggtattttagcagaattgaagatggatccggcgacagttgcgtcgggctatttgcatgacgtcgttgaagataccaatattaccttaggtgatgtgcaagagatgtttggccaagatgtggcagtcattgttgatggtgtgacgaaattagggaaaattaagtataaatcgcatcaagaacaactcgctgaaaatcatcggaagatgttgttagcgatggccaaggatttacgggtcattatggtaaaactagccgatcgtctgcataatatgcgcacgttaaagcatttgaaacccgaaaaacaacggcggattgctaatgaaacgttggaaatttatgcgccattagctgatcgtttagggattagtaagattaagtgggaactagaagatatttcgctacgctatcttaacccacaacaatactatcggattgttcatttgatgaattctaagcggacacaacgtgaagcttatattcaagaagcaattgaagacatcaaggattcagttgccgatttggacatgaactacgaaatttacggtcgtcctaaacatttatattcgatttaccgcaagatgcgcgatcaacacaagcaattcgaagaactctatgatttactcgcaattcgggtagtggttgactcgattaaagattgttacgctgttttaggcgccattcacactaagtggaaaccaatgcccggtcgttttaaagactatattgcaatgcccaaagcgaatatgtatcaatcgattcatacaacggtgattggtcctaaaggcaaaccacttgaagtacaaatccggacgcaagaaatgcacaacgttgctgaatatggggttgcggcacattgggcttataaagaaggcgttaaggaacaaattaagatagatgaatcaggccgtaagttagatttattccgtgaaattctagaaattcaagatgcctcagatgatgcatcagaatttatggaaagtgtcaaaggcgatatcttcagcgaccgcgtctacgttttcacccctagaggcgatgtttacgagttgccaaaaggctcggtaccaattgattttgcctatctcgtgcatacggaagtgggtaatcatgcggttggtgctaagattaacggcaaaatcgtcccattaaattatcaattacgtaacggtgatattgtggagatgttaacctcaactagtgcgacaccaagccgggattggattaagttagctttcacagcccgtgctcgtaataaagtaaaacggtactttaaaaaagaagatcgtgatgaaaatgttgaaaaaggccggacagcaattgaacatttgttgttagaacaaggtcatactgtgaaggcacatctgaacaaggatagcttagcaatcattttgccgcactttaattttaattcagaagaagaattatttgcagcggtgggctttggtgaaatctcagcacaagcggtcttgaaccgattaacgcttaaggaacgtcgtgaaaaagaagagaatgaacaaaaggcactagaagctgaaattttatcggccaaggattctcaaaaaccaggtcaaaaggctgctggtagtcatattacgattaagcatgaagacggcgtcatcatcgaaggtgtcgataatgtgttggtacgcttaagtaagtgctgtaatccagtacctggcgacgatattgttggctatgtgacaaaagggcgtggtgtttcagtccatcgtcgtgattgtccaaatatcgtggatcgtgccgatatgaacagtcgactaacggaagtcagttgggaaaatacgtccgctaaacatgatcaactctacgatgccaacttagaggtctatggttacaatcggggcggtttattaaacgatgtcttacaagtgttgaatgcacacagcaaacaactcaacaatgtcatggggcggattgaccatgataaaatggctgatattcatgtgacggttgggattcacaatattgatcatctcgaacggattatggaagccgttaaaaatattccagatgtttacgaagttaaacgagtgcaaggatagatgaaagtagtcttacaacgtgttagccaagcaagtgtcacaattgaagaacaagtcgttggtcaaatcaacaagggctttttactgttagttggcatttgcgatgacgatacagaggccgatttagattacctcgtcaaaaagatcagtcaattacgggtttttgaagatgaagcagggaagatgaatttggcgttagggcaagttgacggtgccattttatcagtatcgcaatttacgttatatgcctcaaccaagaaggggaaccggcctagttttacaggggcggggcaacctgattatgcgcaaaaaatgtatcatttatttaaccaaaaactagcggctactgggattactgttgaaacgggtgaatttggggcggatatgcaagtcgcccttgtcaacgatggtccggtgacgattttatttgatacgagggataattaaatggcttatcaaaatgcaatttgggactttgatgggacactctatgatacctatccagtaatgttaaaagcgctcgttgcggtttatcagcaacaacaagtaccagttgatcaggatgctttgtacaaagcgattaaacaaacatcaattaaaaagatgttacaagcattagccgatcaaacggggactgcatttgcgacattagaccaacaatatcatcaactcgaggcgaagacgcaaattgcaccgcaaccttatccaggggcggcggctattttagaacgggttagtcagaccgggcgtaacttcttgatgacgcatcgtgatacagcggctcaaaaatatttggcggaacatcatctcgaccagtattttacggagattgtcactagccaaaacgggtttgcgcgcaaaccggcgccggacagtttgaattacctctgcgatcgttatcaattagatagagcgaagacagttatgatcggcgatcgcgcgttggatattgaagccgggattaacgctggacttcaaacggtttattttgacgttgattgcttactaattacggcgcaaccgacagtgacgattactgatttatcgatgctgattgattatttcaataaatgattattttacaatcaatgcgataacgagaaaggtaaggtaccaagcgcctgacattaataagacatagcgccaccagcttttgaaaaacttgcggggataaagcgcatggtcgtaataaaaccgcgttagactccaaatgatgccccatacgcagatgaccaagcagaaataccaaccagctttgttgaaaaatggttggctaagcgcgatggcacttattaaaaatggcacgggtagccagtcgacaaagtgaagttgttttttgaaaaagcgttgcaatacaagatttaagccgtaaccgatggctaaacaaattaacggtaatagaataaagaataacgtagccgtaaatggcatgtgaagtatatgttcatgggtgaatttcatcacacaatcgacacgaagaaccgattgattgtaccagccaagttccgggaagcattaggaactgaattcgtgttgacccgtggtatggacaattgtatcttcggttacccactcagcgaatgggaacagttggaagagaaattaaaacaactgccactcgctaaaaaagatgcacgtgcttttgtgcgttttttctactcagctgcggtgcaatgtaccccggataaacagggccgcattatgattccccaagcattatcaacccacgcttctttagaaaaggaatgtgtgctgattggggtttccaatcgaatcgaaatttggagccaagaaaaatgggcgagctttagtgaagaagctgaagaaaatttcgatgacattgctgaaaatatgttagattttgatttttaaatgacagaaacatttaaacatcaaagtgttttattaaaagaaacggttgatgccttaaatgttcagccagacgggatttacgttgatgcaacactaggtggtggtggtcatagtgaatacttattgtcacaattaacaaccggacatctttattcatttgaccaagacgaccacgcacttgaaagtagtcgccaacggttagcgaagtatgcggatgcaggacaagtgacatttatcaagagtaattttcgatttttgaaaacagcactcgctgaacaaggcatcacgaagattgatggtattttatacgacttaggtgtttcatcaccacagtttgacgatgcccaacgcggcttcagttataaaaaagaagcgccactcgatatgcgcatggatcaaggcgccgagttaacagcgtatacagtcgttaacgaatggtcttaccaacaattgattaaaattttcttcagatatggtgaagaaaaattctcaaaacaagtcgcacgtaaaatcgaacaacaaagagaaattgcacccattgaaacgacaatccaattagcagatttaattaaagaggcaattccggcaccggcaagacggacgggtgggcatccagctaagcggattttccaagcaatccgaattgcggttaatgatgaattaggcgcaattgaagattcagttgaacaagccattccattagttaaagtgggtggtcgaattagcatcattacgttccaatcattggaagaccgtttagtcaaaacaatgtttaaggaacaagcgacattaccagatattcctaagggattaccgattatgccgggcaccgaaaaaaccgttttaaaactggttaatcgcaaaccaatcctaccaacagaagacgagttaacggttaaccaccgggcacacagtgctaagttaagagtagctgaaaaacaaaaagaaatagactagatgatggcaaccaatgcagctcgccaactaacgaccccagaaagtattccgagtcaggttcaagaacctgctcgtcaatcagcgcaacaaacaactcaaaaagtagcttattcaacacttgaaaaattagccgttaccgtaatcgggattgctttttttgcaatgctagtaagcttactctcgactaaaatcgcggtggttaatgcacaacggacattagaaaataccactcaagatatgagtcaaacacgtgctaaaaataatgatttaaaacaagaaatcggggaattaacaagctccgaccgtttagatgcctttgctaagaaaaataatctgaaattaaacgaaaacaatattcggaatgtggctaaatgaatgagaaatttatttaggacacataggagtccacgacagaatcgacgcatatttggcgaagttttattgctgattatcgcggcgatttttctgattttcatgggtcgttttgcgtacatcgccgcaaccgggcatattgcgggtgttgatttaactaaacgatcgaacaagaaatatgaaggcgactccgtgattcgggcacaacggggcacaatttatgattcatcaggcaatgttttagcacaagataccaacgcctatgccgtttatgcggttttgagtcatgattatgtgactgcggataaaaagccattatacgtagcagataagaagaaaacagcaaaggcgctcagcaagtacctcccaatgagtgaagctaatatttataagcaattgacgcctaaaaataaagctgtttaccaagttgaatttgggagtgccgggcagaatttatcactcagcattaaacgaaaaattgaaaagcaacatttgaccgggatttactttaaagaatcaccaacacgcttgtatcctaatgggacttttgcatcgcacgttgtggggattgcacaaacgcctaaaggttcagaagatagtggtagtcaagatttagttggcgtcatgggggttgagaagtatttcaacgaacaattaacgggtcaagatggctataagaatttgacgaaggattcgtatggctattcgattaatcagaacaaaaacaaagtcaaagccgctaagaacggtcaagatgtgtatttaacactagattcacggatgcaatcctatctagaaagtctgttgagtaaagttaataagaaatatcaaccggctagcatgaacgccgttttaatgaacgctaagaccggtgaaattttagcggcctcacaacgaccaacttttaatgcaagtactaaaaaaggtattggtgatgtttggcgcgatactttggtcgaagatggttatgaacctggttctgttttgaagattgcgacgttatcagctgcgatcgattcaggtcactataatccagatcaatactataaatcgggttctgtgttggtcagtggtaagaaaattagtgattggcagaccgctgggtgggggatgattccgctcaaccaagcgtttgcccgctcaagtaatgttgggatggtcaaattagaacaggaaatgggtgccaagacttggaagtcctatattgaaaaatttggcttcctcaagaaaacgggtatcgaattaccaggtgagacggccggcaccttgcaatatgaacgaccacttgatcaggcgacgacttcgtttgggcaagggattaacgtcaatgtcatgcagatgttgcagatgacaagtgccattgctaacaatgggacaatgattaagccgcaaattttggcaggtgttggtcaagaacaacaaatcacaccgattaaagccggtaaaccaatcaaagccagcacggctaagaaagtcatgcaaaatatggaagacgtcgtttataaagattatgggactggtcaggtttaccagattccgggctataaaatcgcggctaaaaccgggacggcgcaaattacgggtcctaacggtggctatttaactggtgcaagcaactatatcttctcagtatcgggaattgcaccggcagatgatcctaaatacattttatatatcacaatgaagcaaccgggtaatatgacggatagtgcggaaaccattttatcgcaagtctttaatccaatgatgaaacgggcgctagagtatacgaaggaagccgaaaaagataagcaacaacaagttaaagtcgcttcggtcttgagtcaatcaacaaaggatgcgcaaaagaaactagaagcgcaaaacctaaagacaacattggtaggtagtggtaatctcgtcgtgcaacaattaccaaaagccggcagtgtcattttgccgaaccaacgggtcttgttgatgaccaacggcgcgatgacgatgccggatgttaatggttggtcaaaaaatgacttactaaaactagcgcaattaacggggatcgatgtggatatcaaaggcagtggttatgcttatcatcaaagtctagcggttaatagtttgttagacggcgtcaagcaaattaaggtacaattaaaatagatgttaacgggacaatttttaatacccctaatgagtgggtttgtgattacggtgatcttcatgccgttattcatcggttatttacggtttaaaaaagagggacaaacaattcgtgatgaaggtcctaagtggcacgctaagaaaaacggtacaccaacgatgggtgggttggtgttcatcgttgccgcagtaatttctagtatctgggtcgctatctggttgcaacaattgaccaatagcttatggatcgcattattcatcctagtactatatggcttacttggtttttcagatgactttatcaaagtcttcaaaaaacaaaaccttggtttgcgggcttggcaaaaattagctggtcaaatcttgggtggcgcagttttcttagcggtttatttccacgaaggtttcagccacgcactgaacataccgttaatcggtacaatttctagcagttggttctttagtttatttatcatcgtgtggttggttggcttttcaaacgcggttaatttagcggatgggattgacggcttggttgctggtttggcaattgtgtcatttgcaacttatacgattattgcttttagacaaaatcaaatcgatgttgcgatttttggcttaacaattattgggggcttgattggattcttaatctttaatcataagccagctcaaattttcatgggtgatgttggttcattagcccttggtggggcgttggcagccatgtcaattctcttacaccgtgaattctcactattattaattggccttgtttatgtcattgaaacggccagtgtgatgctccaagttgcttcattcaaactattccataaacgtatctttaaaatgagtcccatccaccatcactttgaaatgtctggttggagcgaatggcgtattgatattagtttctgggtattcagcattatctgttcaacaatttatctgttaattttttagatgagaaccatcgcaacatatcaaaatcaatctgttttagtattaggactaggtaaaagtggcgttaacgctactaaactattattacaattaggcgcaaaagttactgttaatgatggccaagatcaagaggacacaccagcagtcgctgaattacgggcgcttggtgcaactgtcattacgggtagtcatccagttgctttatttgaagaagggttccattacctctttaaaaacccaggaattcgctatgataatccaatggtggcagaagccatcaaacgcgagattcccgtcttgacagaaccagaattggcttatgaagtttctgaagctgactgggtgagtgtgactggctcaaacgggaaaacaactacgacgactttaatcgccttaatgttgaactatcaacgtgcacaaggacatgcatatgccgccggaaacattggtattccgttgagtgaagtcgctcaaaaagcaacggccaaagatacaatggtcaccgaattatcaagttttcaattgatggggacaacaactgttaaacccaaggtagcagtcttaacgaatatctacgaagcacatctcgattatcacgggacacgtgaaaattacgtgcaagctaagatgcggatcgtccaaaatcaaacagcttctgattactttgttgtgaactgggacttaccagaattaagaaccttaagccaacaaaccaaagcgcaagttgtgccattttctagattaggcacttctgaagaaggggcctatgtcaaagatggccaactatgctttaaaggtgaagtcatcatgccagttacagatattaatgtccctggcgatcacaatgttgaaaatgccttagcagcattggcagccgctaagttaatgggccaatcaaacgaagcgattattgaagtcctaacgacctttacaggcgttaaacaccggatgcaattcgttaaagaattcgcagggcgtcgtttctataacgattcaaaagccacaaatatggaagcgacagaggttgccttgaagagtttcaaacaacccatcgttctcattgctgggggccttgatcgtggctttacgtttgaaccattaactgctttattgaaagcccatgtcaaagcgattatcctttatggtgaaactaagcagctgttggcacaaacggccaaagaagccggaattgaaacgattgaaattgtcgatcaactaactgaagcagtacccgcagcttacgcggcaagtcaagagggtgatgtgatcttattatcacctgcttgtgccagttgggatcaattcaaaacgtttgaagaacgcggcgatgtctacattgatgcggttgaacaaattacagaataaatgagagtaatgatatctggcggtggcacaggtggccacatttacccagcactagccttaattgaacgtctaaaacaacgtggtttgttagatgctgtattatatgtcggaacagaacgtggtttagaaagtaaaattgtgcctgatcagggcattgattttaaaacacttgagattcaagggtttaaacgctcaatgaatcttaatgggattaaaactaaccttaaaacaatcgaattattcatgagcagtattaagtccgctaaaaaaatgattaaagaattcaaaccagatgttgtcattgggaccggtggttatgtatcagggtcacttttatacgccgcaagtcgtttaaaagtaccaacgattattcatgaacaaaattcagcagccggtgtgacgaataaattcttagcgcggtttgttgataaagtggcgatttcttttgaatctgttagcgaccaatttccaatgcacaaagtcgttttaacagggaatcctcgggcccaacaagtggccggaatggtcccaaatgaacgcctaagcgaatttggtttaaaaacggatagtccaactgtcatgatttttggtggtagccggggcgccccaagtatcaacaaggcgtttattgatgcggtgccacttttaaacgaacgtgactatcaagtcctattcgtttctggtcaagtccattacgaaaatgtacaagcagctttagccaatactactttaaatagtaatttggcgttcgtgccttacattagcaatatgccagaagttttacctgacttgaaggcaattgtcggccgggctggtgccactagtcttgccgaaattacggcattagggattccatctattttaattcctagtccatacgtgacaaatgaccatcaaactaaaaatgcgcaaagtttagtgaaagaagacgccgctattttaattccggaatcagaattaacgggtgatagtcttgtcaaagcactagatacattatttgaaacaccagaaaaacaacatgcaatggctaaagccgctaagaagagtggtattccggatgcatcagaccggattattgaggtcattgaaacgattatttaattgaaaaataaaaaaaagcagctcgggtcacatgatccgctacagttattaaaggtgtggcgcgcctatcagattaagcggtggaaacgacagcgtcgacaacgtttaaaaccagggcgcccaacaattaccaatcaactaccacagctcaaaaaacaacgtggtaaaaagattagatggcaactagtagtcattctagggatttttactttagggagtttgactgcaacttatttcatttcaacaaaaagtgatattcaacagttagccgttaacggcacaaagtcggtacccgatcaacaggtcattaatgcaagtgggattcagcttggcgatgatgtgttgtggcaattaatgcaccacacgaaagctaagaataatattcaaacgaaattacctaagattaaacaggttagcttgcaagtgagccaaatgaatcacgttgcaatcaatgtttcagagtataagacagtggggtatatgtttaagcataagcagtattacccaattttagaaaacggcactattttgaaaacgaaaatgactcagtcattagggaatagtccggtttacagccattttaaaaatgatcgttatttgaaactgggtcttaaactctataatgatattcctgatagcattcaaagtgcggtttctgagattcgtttaacggcacaaaatgataatccttatcaagttcacttatatatgaatgatggtaacgaagtaattggtgatttaagaacattggccaaaaaaattaaatattatcctgttttagtgaaacaaatggatggcaagggtaaaattgaccttgaagtgggtgcgtattcaaaattatttaagcaatcgaagtcgtaaatggagaattcaaaaatatatgttgggcttgatgttggaactacttcaattaaagttattgttgcagaatcaatgaataaacaattaaacgtgatcggtgttgggtcggcaagatctaatgggttgagtcgcggcacaattgttgatattgatcaagcagtttccgctattcaacaagccgttcaacaagcagagcaaaaagcaaatattgaaattacacaagttgtcgcaggtattccagctaatctattacagattgaagaatgccaaggcatgatcgccgtttctgatcaatcaaaagaaataacaagtcaagatgtacaagatgttgcaagcgccgctttagtgcggaacttaccaccagaacgtgagattttaacggtcttaccaatgcagtttactgtagatggttttgacggaattaaagatcctcgcgggatgatgggtgtgcgtcttgaaatgtcaggaattttattcacggcacctaaaacaatgattcacaacttaaagaaatgtattgaaaaagcaggtcttgaactctcacaactggtcgttaatccattagcattaggtaaattagcgttatcagatggggaacaagactttggcgcaattattgttgatcttggtggtggtcaaagtaccgctgcagttattcatgatcatcaattaaaatttactgcaattgaccaagaaggtggcgaccacatcaccaaagatatttcagtggtcttaaatacatcaattgagaatgcagaaaaagctaaacgtgattatgggaatgcggattcactagttgcttcagaggaagaacaaattccaatcgaagtcgtgggtcaaacagcgccgattcaaatcactgagaagaaactagctgaaattatcgaagcacgtatgatgcaaatctttgatcgtctcaagacggccttggataaagtcaatgcgttcgatatgccgggcggaattgtcatgaccggcggtgtgacagctttacctggaattgttgatttagcacaggaagtttttaattgccctgttaaactctacattccagatcaaatgggattacgtcatccttcgtttgcgcaagggttaagtttaattaactacatagctaacttgacggaagtggattggctggttcaaagtgcgcttggcaatgtcgagcaatttgaagcacgtcaaacagcgacgaagtcaactgctaagactcaagcgacacctaaagaagcaccacaaaagaaacataaaactgaatcaaagcatacattcgaaggcctaaaaagtttctttagtaacttttttgaatagatggaatattcattagatgcggaacaagaaaacaatggcgcagttattaaagtaattggtgtcggcggtgctggtggcaatgccgttaaccgaatgatcgatgaaggcgttaaaggcgttcattttatcgcggctaatactgacgtacaagcgcttgaagattcaaaagcagaaacaaaaatccaattaggacctaaattgacacgcggtttaggtgcaggttcaacacctgatattggtcaaaaagctgccgaagaaagtgaagaagttttagcagaagccttaaaaggcgctgatttaatcttcgttactggtggtatgggtggcggtactggtaccggtgcagccccagttgttgctaaagtcgctaaagacttaggcgcattgactgttggtgttgtgacacgtccatttacattcgaaggccctaaacgtggtaaaaacgctgcttcagggattgctgaattaaaacaacatgttgatacattagtcattattgctaataaccgtttacttgaaattgttgataagaagacaccaatgttggaagctttccacgaagctgataatgttttacgtcaaggggttcaagggatttcagacttaatcacatcacctggttatgtcaacttggattttgctgatgttaaaacagtaatggcaaaccaaggttctgccttgatggggattggttcagctactggcgaaaaccggacagcagaagcaacgaagaaggctatttcatcaccattattggaagtttcaatcgatggcgcagaacaagtcctcttaaacatcactggtggcccagacttgtcattatttgaagcacaagatgctgctggtatcgttcaacaagctgcaacaagtgaagtcaacttaatcttcgggacatcaatcaatgaaaatcttggagacgaagttgtcgtaactgtgattgcaactgggatcgataacgatggtaaaacaccaaaacgtccagaagctgctcaaacaacaagtcaacctgtacaacctagtacacctaaacaaacaactaatgacgatcctttcggcaattgggacatgcgtcgtgaacctaatccacgcgaacaagcgaaagctactgaaaaatttgatgaagttgaaaagaaagacttcgacatcttcaaacgaacagcacaagtagacagtgacgctgtggatacaaaacaagataacaatgatgtacccccattttttaaacgacgtcgtaaataaatggctggtaaatttagtttcagtaattttttcggcatgacagaagatgaagattattcgactgatctgcaaggaaccaagacaactgatgaagtcagtccaacatcacgtccggataatattatttcaatgaccgccgcaggcaatgctaagatgaataaaatcgtactttgcgaaccacgtatttactctgacgctaaaaaagttggtaagcatttactcgaaaataaagccgttattgttaattttacgagaattgagggtgcacaagcgtcacgcataattgattttctgaccgggacagttttcgcaattaatggtgaaattcaacgggtcggtgaacaaatctttttatgcacgccaccaaactatgaaattgacggtaatctatccgatattatcgatcaaaatgattttgattctgaggtgaactaagtgcaatttgtaatctatttattaatgttcctaatgcaagccacaaggatttatgtgggcatcatctttatttattgtctattaacttggattccaggtgcgatggattctaaattaggtcagctacttgcgagattggttgaacccttcttaggggtttttgaccggatcataccagcaattggtggtattggtttttccgccatcattgctggctttgtcttgtatttagtcgaacgtggcttagggacgattattcaaatcttagccatgaggtattactaaatggctgataacgaagctgtttatcagcactttagaaaaagtgaagcgccatttgttgcacaagttcttgattggattgaacaagcaacaactgaataccgtgcaatattaacggattttttagatcctagacaggcttacattctacaaaccttaattggtgaaaagggtgagcttaaataccatttcagtgggggctacaatgctgctgaacgacaacgtgcgttgattgcaccaacttattttgaacctgaggaagccgattttgaaatccaactctttgaaattcgttatccaattaaatttgcacagctttcgcatggtaagattttaggaacattggtcaacgctggtattgatcgaaacgtgtttggtgatatcatgacggatggtcaacggtggcaattttttgtcacaactaagatggctgactatgtggtgaatcagattacgaagattggtaaagttactgttcaccttgaagaacaagcctatactgagttgattatccccagggatgcttggcagtttgaacagctattagtcagttcattccgactagatacgattatcgcggcagtttataatatgtcacggcaacgtgctaaagagcttgttcaaggtaataaagtgaaattgaattggcaagccttcgataagcctgattttgaattagacttattagacattatttctgtccgtggctatgggcgtattcagctcaaatcaattgatggtcaaacgcgtaaagaaaaataccgtgtgacacttggtattctaagaaaataaatggttttaacacctttagatattcataacaaagagttcggcaataagatgcggggatataatcctgatcaagttaatgactttttagaccaagtgattaaggattacgaatcagttttaaatgaaaatgatgctttaaaagcagaactaaaatcaagtgatgaaaaggtcacttactttaacgaattaaaagatgccttgaaccaatcaattattgtggcccaagaagcagccgataaagttaaagaaaatgctaaaagagaagctgaaattattcaaactgaaacagaaaagaattctaaatcaatgttgaatgatgcgactgaaaaagccaaccacattattgaagatgcaactgaacgtgctaaacaaatcgccatcgaaacagacgatttgaagaaacaaacacgcgttttccgtcaaagattacaagtgatgctcgaatcacaattggaagttgttaagagccccgaatggacagacctattatctaaagatgatttagctggtcatgaagcattatctgcagaaattgacctcacagaccttgacagcaagaagcataatctagtagactcagagacagtagttaaaccatgggatgatattacgactgatgacttttctgatcaaacaacccatacgattgttttccctgatgataagttaccagaagtagctgatgaagaagcacctgaagaaccagtcattaaggccgatactttagatgatgaaattcaatcagaagaaactcataatgactatggctataatccaatcgaagaagacgatagcgaaccattaacagacaataacaagaattaaatgcgtatcaaagaaacattaaacttgggtaagacagctttcccaatgcgagcaggtttgcctaatcgtgaaatcgattggcaaaaaggttgggccgataacaacctttatcaacaacggcaaaaattaaatgaaggtaaaccatcattcgtacttcatgatgggcctccatttgctaacggtaatatccacatgggtcacgccttaaataaaacaagtaaagatatcatcgttcgttacaaatcaatgaacggtttccgcgcaccttttgtccctggttgggatacacatggtttgccaatcgaacaagccttggctaaaaagggtattaaacggaaggaaatgagccttgttgactaccgtaaactttgttacgactatgccatggaacaagtcaacacgcaacgccaagatttcaaacgccttggtatttctgctgattgggataatccatacatcactttaacagctgatttcgaagctgaagaaattcgtgtcttcggtgaaatggctaaaaaaggctatatctataaaggtaagaagcccgtttactggtcaccttcatcagaatcaacattagctgaagctgaaattgaatacaaagacatcaagtcaccatcaatgtacgttgcgtttaacgttgttgatggtaaagatttattagatgctgacacaaaattcatcatctggacaacaacaccatggacaattcctgctaacttagggattgctgttaacccagcttttgattatgttcaagtattagctgacggtcaaaaatacgttgttgctgcagaacgtttgaacaagatgactgatcttcttggttgggaatcagttgaaatcttgaagactttcaagggtgctgacatggaattaatgacagcccgccacccattatatgaccgtgaatcattggtgatcttagggaaccacgtgacattagaaactgggactggtttagtgcatacggcaccaggtcacggtgaagatgattacaacgctgggacaaaatataagttaccagtgctttcagtcgttgacagcaaagggattatgactgaagatgcccctggctttgaaggtgtttattacgacaaagcaaacccaatggtgacagaagcgcttgaaaagaacggctcattattgaaactcgacttcttcacgcatagttacccacatgactggcggacaaagaaaccagttatcttccgagcaacagcacaatggtttgcttcaatcgatgcgttcagagatcaaatcttggcacaaatcgaaaaagttgaattcatgccagaatggggtaagacgcgtctttacaacatgattcgtgatcgtggcgattgggttatctctcgtcaacgggcatggggtgtgccattaccaatcttctacgctgaagacggtacagaaatcatcacaccagaaacaatcgaacgtgtggcacaactctttgcagaacacggttcaaacgtttggtttgaatgggatgctaaagacttattaccagctggctttacacatcctggtagcccaaatggtgaatttacaaaagaaaaagatatcatggatgtttggtttgattcaggttcatcacatcaagctgttttagctgctcgtgatgaattaacttatccagcagacttaatcttagaaggttcagatcaatatcgtggttggtttaactcaagtttaatcacgagcgttgcggttggcgaagtgagcccttataaggctgttatctcacaaggcttcgtcttagacggtaatggtcgtaagatgagtaaatcacttgggaatacaatcctacctgaaaagatcattaaacaaatgggtgcagatattgtccgcctctgggtagcctcagtcgatgctagttcagatgtgaaagtgacaatggaaaacttccaacaagtcagtgaagcttaccggaagatccggaacacaatgcgctttatgatcgctaacacaaccgactttgatcctgccaaagacacagttgattacgcagaattaggctcagttgataagttcatgttggttcgcttaaacgcaatcattgaaagttgtaaagctgcttacgatgcttacgattttgccacagtttataagacaatcaatatgttcttaacaaacgaattatcagccttctacttagacttcgctaaagatgttgtttatattgatggccaaaatgatgcgcctcgtcgtaacatgcaaactgttttctatgcagtagcagttgccttgacgaagttattaacaccaatcttgccacatacagctgaagaaatctggagctacttacatgaaccagaagaattcgttcaattagctgaaatgccagaagtggcacattttgccggtgaagaagacttagtcgctacatggaatgctttcatgggtattcgtgacgatgtcttaaaagcccttgaaacggcccggatggacaaggtcatcggtaagtcattagaagctgccgtaacactttatccaaacgaagccaatgctgctttattagcttcattagatgctgacgttaaacaattattgattgtctcacaattaacaattgctgaccaagctgtagaagccccagcagaagccacacaatttgacggcgttgctgttagtgttgctcatgccgaaggtgacgtttgtgatcgttgtcggatgattaagaccgatgtcggttcagacgacaagttcccaatgctttgtgcgcgttgtgctgcgattgtcacagccaactacccagaagcagttgctgaaggtttagaaaaataaatgaggaaaggacaagttatgaagcaacatatggcattaattttaatgcaattattatcaaagaaacggcaacgaaaattaaccgtcgctgagtttttagaacaggcagaggtctcacgaacgaccttttattatcattttccaaatgggatgtgtggtctgtttagatggacattagagcaagaggtactagcgctggtgaggcaggcgatttgcgccggccactgggaagagggctgtcacgagatggtccaattcattatgcgttatcctgaattttgtttaaatctctatcgtttctcggatgaaatgctgcgttgtgctttctttgaatccttcacaacgactgtctttaaacaagtacttgaaaaatatcggccacactatactgattcggagttgaaagactttgagatcttttacagtggggcactcattaaccaaattgatcgttggtttgaaggtaatttaaaagaatctggcgaggccgttgatgtgcgcgtctgttttaatttacgtcaaatcgaacggctgatgaaataaatgaaagcctatcagacaattttattatcgagtatggttttaagtacactaaacacggggaccgtattagccgatacagctaatcaaaaaacaactacggatcaaacagaacggaccaaggccgtcagaacttacagataaatgagacaattgatattagtcagtcatggtgatttggccaaaagttatttaacgagtttagatatgattgccggcgggcatgataatgtaacggccatcaccttcgattgtgaaattagtaagacgttattaggtgatcaaattgaagttgcgcttaaaccagatgcacaagaccagatgcacaagaagtgagtgataatcgttgttgatttaccaggcgggatgccatgtaatgtcgtactagaacgctatttaacagatgagcgcatcacaattttagccagtttgaacttaccaatgattttagagctttatttaaatcttggtcaggcagattatcaaatgtcacaagtgattaaaacggctatttgtaatacctatgatgtgaaacaacaactcagtaaccagactgaagacgatgaataaatgcgtaaaaaactagtcattactgaaaaaccgagcgttgctaaagagcttgccaaggttctcggtactaatcagaaaactaaaacctattttgaaggcgatcaatacctaattacatgggcgtttggtcatcttttatcattacaattaccggaagatattaaaaaagagtggcaacaatggcgtttagaagatttaccaatcattcctaagcatatcgggcttaaaccacttcctaaaacgggtgggcaattaaaggctatcagccatttggtgcatcgtcaggatatttcaggggcagtcattgcgactgattctggccgtgaaggggaagctgttgcccgttatattttggaatggattaaatttgataagccagtcgaacgactttggatttcatcacaaacgaccaaggcgattaaagacggttttgccaatctgaaaccagctaagcagtttgataatttgtacgcttcagcgcttgcgcggggccatgcggattggttgattggcttgaacgtcacgcgggccttaacgacgaaatatgaagataatttgtcagcagggcgggttcaaacaccaacattggcttttgtgaacgaaacagcgcaacaaatcagtcgttttaaacctgaaaaatattacacaattcaattgaaagttggccaagaacaagccacgctccaaatggctaaaccacagggcttaaaagaccgtgcgcaagccgaaacgctagtcgctaaattgaagcaggcacaaggtaaagtgggtagtgtcaagacgagccaaaaatcacaagctgcaccactgccttatgatttgacggaattacaacaagttgccaatgcgatgtacggcttgtcggctaaaaagacgttgtcattgattcaatcattatatgaaattcataaagttgttagttatccgcggacggattctaaatatctttcaacagatattgaaggcacattgaaggaacgtttatcggccttagtgaagtttgatccgcgcgccaaacaatacttagggcagggcgctaaagtgaaacaaccggctgttttcaacgatcgaaaggtcactgatcactacgccttaattccaaccgaagaaccagtcagagctgaaaaattatctaccgatgaattgcggatgtaccgtttaattgtcgaacgctttatgggcttgtttgcggatcaatatgtcacagccgttacaaaagcgactgttcagtttggtgatcacacctttaccttcaaacaaactaaagtcgttcaacaaggttggcacgcggattcaaaagaaacaccaactacaagtgttgattggcaagaaggcgcagtggtgcctgctaacttttcaattaaggaacaattaacatcagcgccgaaacccttaactgaagggaccttattaggtaagatggaacactatggcttgggcacaccagcaacgcgggccgaaattatcgaaaaattggtgcgtagtgaactcttagaacgccgtggccattccttagcagtgacacctaaggggcaacaactgttgaaattggttaataaaacattggtctcaccagaattgaccggtaaatgggagaattcattagaggcgattgcgcgtggtcaagaaaatcaaaaagcgttcatcactgaaatcaaagcggccactaagaccttggtttctgagattaaaaagagtgaaactgaatatcacgatttcgcgattaccaacaagaaatgtccagaatgtgaccatccgttgaaggagcgtaatacgcgtgacggcaaggtttacgtctgcacaaactgtcattatcggcgtcgtaaagatcccaaagtttccaaccatcggtgcccacaatgtcataagaaaatggtcatcattgaaggacaagccggtgcttatttccgttgcttgaatgatggaacgacagaaaaaatgctcgataaaaaagattgtaagaagaaaatttcaaaacatgaagaacgccgcctaattcaaaaagtaaaccaagaagaagagccagctgaaagtccactagcagcagcattgcgcaaggcaatggagaaataattagaatcgatttttgatattattgacggtattttctgtcccttttacaatcggatgattatcttttacttgaatgttggcatctaagtgagaacgaccggttgcgtagtcaaaggcgacgccgggttcgatgttccagacataatcgttgaaattaagggtgccatctgtcgagatggcttggacccagtaaccgcggggcattaattcattaccacgaaagacggttgtcactttatagattacttttttattagcggccagtgcgttacggaccttttcttcgaaaatctgcattgtcttttgattactatattcggtttgagtcgccaggtttaacggattatctaaactacctggctgccccgattgaaagtgaccattttgatcaaaattaaaactaatggtgtaagcaatcaggtggccacggttttgaggtgtgatgcggcgaccgttgacgaccagtggttgattatgccaaccagtcggattccaaacttggcgtgagcgcacttcagatttccctaggttgcgggaagacagataggctgttgccgaagtggttcgattgagttgatctaattggccgtaatcgattttttcgctggtccaatctgcactagtcaactggcttttgtcgttgttgatggcaagataagcggcgctgccattttcaaagtcgcggttagcaattgcctgataatcgggactgacttgcgcctgttgtatggtggattgtgtaatggcggggattttctgggtgatatcttgcaggatattattgcgaccacccaaataaccaatcgcaaggatggcgacggttaataatagccgacgcatttttttcgttttcaattattttgaactattacgcaatgttagtgacgtcccaatcgtaatgacttgtggaatgacttgttccgcgtcgagttgcttaattaataattcagctgctgattggcccattcgttcagtgtagaccttgaccgagctgagtgttgggaacgtgtattggcagattgacgtgtcattaaagctaatcaaactgagttgctcaggcactttgatggctgcttcgtgaagggcgcgcagtgcgccaaccgccatggcgtcgttagcgatgaagagtgcttctggtaagttatcggcctgttcatgaagtaactgtgtaatgagctggtaaccagattccggtgtgaaatcgccggtaagtagccattcgggatggaagttgttttgctttttaagataatgtttgaagtgggttgagcgggggtcggtgcccaatttaacattgtcggacgtgctttcttggcctgttaacatcccgattttcgttaaaccactcgccataaaatgatcgacaactgctttgaccggtgttttgaaatcggtcatgacacaactaatctcgtagtctaaggtattcatatcaataaagacgagattgcggtttaatttctttaaacgggtaatctgacccaagctgtatttaccgatgacaatgacacccgcggcatcaaaaagggtatcgaaaggatcgttttgaaaaaaacgagtgacttcaaaaccgagttcttgcagcttcttttcaacgcccaggcgaattgataggtagtagaggtcttccaattcttctgtagcggtataccattcgacaatggcgatgcggccccgatggttattattttttttagtatttttagtgtagctaaggctttcagcagcttcaaaaatgcgttggcgggtttcatcactcacagaaagggactgatcgtaatttaaaacccgggagacagttgcgtttgaaactttagctaattgtgcgatatctttaatagttgccaaatgaacatgacagaattgaataccgcatttaaagcagcctacaacaaggaacctgaagcaagttactttgcccctggtcggatcaacttaattggtgaacatacagattataacggcggacacgttttcccaacagcaatcacattagggacatacgcagtcgttgctaaacgtgaagaccaaacaatcaatcttttatcaggcaacttcgaagatgccggtgtcatttcatttgaccttagcgatttatcatatcaaaaagcacacaactgggccaactatcctaaaggcatgattgtttacttacaagaacaaggttatacaatcgatcatggtttggatatttatttaaaaggtaatattcccaatggtgctggtttatcatcgtcagcttcaatcgaattattaatgggtgttattttagaagaccaattcaacttagatatcgaccgtgtggaccttgttaaaacagggatgatggttgaaaataaatttatcggtgttaactcaggtatcatggatcaattcgcagttgggatgagcaaggctaaccacgctattttacttgataccaacaccttggattatgatttggtcccaatcgacttacaagacaacgtgatcatcatcatgaacactaacaaacgtcgtgaattagctgattctaaatataacgaacgtcgtagtgaatgtgaaaaagcattagcgattttacaaactaagaatgatatcaactcattaggtgatttagataacgaaacatttgatctacaaacatacatgttacaagacgaaaacctattaaaacgtgctcgccatgctgtatctgaaaaccaacggacaatgaaggctagagaagccctcaagaacaatgaccttgaacgcttcggtaagttagtgaacgcatcacacgtgtcattacaatttgattatgaagtaacagggattgaattagatacattagttcaatcagcttggcaacaacctggcgtcttaggtgctcggatgactggtgctggctttggcggttgtgccatcgcgattgttgcaaaagaccaagttgaaaactttgaagaaaatgttgctaaagcttatacagataaaattggttatgccccaagcttctatgtcgcagaaatcgctgacggtgctaagaagttaggttaaatgtcaattctagtattaggcggtgccgggtatatcggttcccatacagttgatcaattaattgaacgcggttatgacgtcgcagttgtcgataatttagttacgggacataaggcagcgattaacaccaaagcccgtttttataagggtgacgtacgcgataaagaatttatgcgcaacgttttccaacaagaagacgttagtggtgtcattcactttgctgccttttcaatcgtgccagaatcaatgcaatcgccattaaaatattttgacaacaatacttatgggatgacggcgttacttgaagtgatgaacgaattcggcgttaaacggatcgtcttttcatcaacggcggcgacttatggggaacctagggcaatttcaattaaggaatccgacccacaagtaccaaccaatccttacggtgagagtaagttgatgatggaaacaatgatgaagtgggccgataaagcttacggcatcaaatttgtcgccttacgctatttcaacgttgttggtgccaaaccagatgggtcaattggtgaagatcatcatccagaaacgcacttgttaccaatcgtattgcaagtcgctgctggtaaacgtgatcaattatcaatctttggtgacgactacgatacgccagatgggacaaacgtccgcgattacgtacacgtattagatttagcggatgcgcacatcttggcctttgaatatctcaaagacggccatgatagcaacgcctttaacttgggctcatcaactggcttttcaaatatggaaattgtcgaagctgctcgtaaagtgactggcaaggcaattcctgtgacgatggcccctcgtcgtgccggtgatccaagtacattgattgccgcaagtgacaaagcacgtgaaacgcttggctgggcccctaaatatgacaatatggaagcaattattgaaaccgcatggaattggcacttaaaccatcctaatggttatgcagatcggtagatgcaagtaagagaattgattcaaaagtttattacaaaagtcagcacttttccagaaacaacttatacggctgaagatgaacaatatttatttaacgttgtcctcgacttagttggcgaaggtgatgagacaccagttgttgcacaagagacgacaactttgattgacttgaaagaagcattggtccaattggcagttgaccatcagcgtattcaagatttagcggctgaacgcgatattttgggcgctaagttgatggatttggtgacaccattgccaagtgccgttaacaaacgtttttggacgttatacgaaaaggacccagaaaaggcgctagcttatttctacgaattaagccaagccaacgattatatcaaggttgctgcaatcgcgaagaatatcgcttatgatgtacccactaaatatggcgatttagaaattacgattaacctctcaaaacctgaaaaagatcctaaacaaattgcgttagctaaaacgatgaaacaaacgggttatcctaaatgccaactttgtttagaaaatgaagggtatgcgggtcggttggatttcccagcgcggcgtaatcatcgcattgtgcgctttgatttagaacaacaaacatggggcttccagtattcgccatatgcttatttcaatgaacattcaatcttcttggatggcaaacacgaaccaatggtgattgatcaaaccacgtttaaaaacctactacaaattgttaagcagttccctggctactttgccgggagtaatgctgatttgcctatcgtagggggctcaattttaacgcatgaacattatcaaggcggccggcatgattttccaatggccaaagcaccaatcagcacaccacttcaatttgcgggttatgatgatattcaagccggaattgttgaatggccaatgtcggttattcgcttgacgggtagtgatgctaagcgcattgaaacacttgctgctgacattctgactaagtggcaacactacagtgatccagaagtccaagtcttagcgcaagaagcagacgggacactgcatcacaccatcacaccgattgcgagaatgcgtggggatcaatatgaaattgatttggtcttacgtgacaatcaaacatcgccagaacatccagatggtatttatcatccacacgcagatgttcaacatattaaaaaagaaaatattggtttaatcgaagtcatgggcttagcgattctaccaccacgtttgaagtctgaaatggcagaagttgaaaaatacctctgtgatcaaccaaatgaaatggccgcttatcacaaaacatgggctgaccaaatcaaggctgatcatttagcaatcacaccagccaatgttacaacattggttcaaaatgaagtcggtaaagtcttcatgcgtgttttagaagatgcgggtgtcttcaagcgcgatacaaaaggacaagcagcatttatcaaatttacagagcgtgtcaacaatgcctaaatgaaatattggcgtcaggaatttgggacgattaatggtcagactgtttggcaacattggttagaaaatagtcagggctatcaattagcagttatcgattatggggcaaccatcacgaatttagtgatgcccgataaggcgggacaatttaaaaatgtggtaatcggttacgataatttagcggattatctcaaacaagaagcttactttggcgcgactgttggccgggtagccggtcgaattggtaaaggggccttcacattagacggccacgattatcaattaccacttaataacggcgaaaacaccaatcatggtggtcctaatagctttgaatctcaagtttggcaagcaagcgttgaagaacaagccgacgcaattagcgttacttttaaattaacaagtcctgacggtgccaatggcttcccagggaacttatcagttgcgacgacttataccttgaatgaaaaaaatgaatggttggttgattatcaagcaacatccgaccaaacaacgcttttcaacccaacttgtcacgtttatttaaacttaaccggggacttcgatcaattagttgacggtcatcaattgcaaatcgacagtgatcgtttcggcgaaattcaaccagatggtctaccaaccgggcaattattgccagttgatcaaactgttttcgatttacggcaaccacgtgcaatcgctgatgcttttgctagtcaagaaacacaaaataaattggtaaatggctacgatcacccattcttattaaataaaaatgctgatcgaaatgatgcggttttaaccgaaccaactagtggtcgctcgctaacgattaatacggaaggtaatgcaattgtcatctacactgccaacggtttcgggagcgaaccaaacttgactgataaagcgattcaaccgcacgaagcggtcgcaattgaagcccaaatgatgccggatgcgattcatcatgcggactttggcaatgttattttaaaggccaatgaacagtaccatcggcaaacatgttacaagttgaattaaatggaaaaaggaacagtaaaatggtttaacaatgaaaaaggttttggttttatctcagttgaaggccaagacgatatcttcgtacatttcagtgctatccaagacgaaggcttcaaatcattagaagaaggccaagccgtagaattcgacatcgttgaaggtacacgtggcgcacaagctgctaacgttaaaaaactataaatgcaaaagaatattattgatgaattaacatggcgcgacgcaattaaccaacaaacagatgctgacggtttacgtgaattaactgaaaagaagagtatctcattatactgtggggttgatcctactggcgatagtatgcatatcgggcatttaattcccttcatgatgatgaaacgtttccaattagctggacatcatccatatatcgttatcggtgggggaacaggttcaatcggcgatccaagtggtcgtaaatcagaacgtcaactccaaacaatggaaatggtccaacacaacgttgaagctttatctggccaaatgaaacgtttattcggcgaagatgccaatgtttcaatggttaacaactacgactggttatcaaaaatttcattgttagatttcttacgtgattacggtaagttattcaacatcaacacaatgttggctaaagacgtggttgctagtcgtttagatgttgggatttcatttactgaattcacataccaaatcttacaatcagtcgatttcatgcacctttacaaagcacacgatgtgcaactacaaatcggtggtgctgatcaatggggtaatattacttcagggatcgatatgattcataaaattgaaggtagcgaaacagaagtctacggcttaacaattccattgatgctcaaggctgacgggacgaagtttggtaagacagctggcggtgccatctggttagatcctgaaaagacaaccccatatgaattctaccaattctggttaaaccaagatgaccgggatgttgttaaatacttgaaatacttcactttcttagatgaagctgaaattaacgaactcgctaaaacagttgaaacagcccctgaaaaacgtgaagcacaacgtcgtttagctgaagaagtgacacgttttgttcacggccaagctgaattagaaggtgctcaaaagattacggaagtacttttctcaggtgatatcaaagccttagatgtcaaagaagcagaacaagccttccaaaaagcaccaacagttgaaatcacagctgaaaagaaaaacatcgttgatttcttagtggatgctggaattgaatcatcaaaacggcaagcacgtgaagatgtgcaaaatggggccatcacaattaacggtgaccgtctccgcgaaacaacacttgaaattgacccaagcgaaaacttcgaaggtaaatttgtcattgtccgtcgaggcaagaaaaaatacttcttggcaagagtaaaataaatggcgttaagttatgcagataatccgcaggttcaaaagaatcgttggcggatattaacggcggtggggctttttaccttcatggccaccctcgatgggagtatcgtcaatattgcgttacctgtcatgagtcgggatttgaaaattccgatgaatcaatcagaatggatcgtctcgatttatctgattatgatttgtgcactactgctattatttggtaaagttggcgatgccttcgggaaagttaaagttttcaagattgggactcttcttttcgtattgggctcattactatgtgggtttaacggtggcctaccattgctacttggtgcgcgggtcgttcaagcgctaggagcttcaatgacaatgagcaataataatgggattatcaccgaagttttcccattaaaagaacggggccgagcattagggttaaccggttcatttgtggctttaggcagtatcgcgggtcccgggattggtggtttaatcctcgcgcactttagttggggctatattttctggattaacgtgccaattggtattttaacaattatttttgggcattttattttaccaaaagatattattaaaacgcatgaaaaaattgattatgccggatttgtcagttttgcggctttgattgtcagcttgttccttggcatttttatcggccaacaaattggctttacatcaccaatcattttaacggcttttgtggtagccttgatcagtgccgggatttttgtttggatcgaacaacatgttgaacagcccttattatcatttagattattcaaaaatgttgattttagcttgagtttattatgtgcattcttaatttttatcgttaatttcttcttcaacgtcatttcaccattctatttggaaaatgcattgggtttagcgcctaatttggccggttatagtttaatgattttcccaattgtgcaagtggttgtagcaccgattgctggtagtatttcagataaaattggcccagagctattaacttttgtcggcttgattttaatctcaattagccaagtcggttatatgttgatgaatttacaaacgccaatttggttattcatgttcttcgtcggtttagtcggactgggcaatgggattttccaagcgcccaataacacgatcgtcatgagttcagttggggttcaagacttgggggtcgccggtgggattaacgccttagcgcgtaacttaggcatggtctttggaatttcactatcgacaacagtcttgtacgccgcaatgagtcgtaattacggtcaaaaagtaacggggtacattccaggtcacgcggacgtcttcattgccgggatgcacgatgctttcatggtcgccttggttatttgcttgattgcgacagccttaacaggttggcgaatgttgaaacatcgtcattaattaggaattgatggctttttcgttagctgaaatttggcggctcttaatcaaatactgtgcgagcgttatgataatcagaaggttactgaactgaaaatgataccgctggagcggcaatccgacaagaagcactaataaaaggattaagtagtctttttgtcgtacggtttgagcaggtttaagattgatgaaaacccctatcattagggcgaatatgaaaaagagtgtgatgaagtaaaataggttaaacgttggttctgatggtgctctgagttctaagtagttacttagaattaaaccccataaattaatgattaagtaaagatggcgtttggaaaagggtattggtttgaaggccatttttgtgataaataatcgtgtaaaaagccagatgccccaaataccgattaaggtttgactgagataaacaatcattaaaatgaaagtaattcgagaattaaaaaccgatgctactgctgttataccaacacttgtgttggtgaaaaaagcaactacggtgagtgtgatatcagataatccaagtatcaataaactcgtcaaggcgagatatacgttaatttgacatcttatctgataaattaaaatggctaataataaacataatattactgccgtgatatccgataccaatatgccttttggtgccatacggcagacgagtctataggaccactcaaagaatggaaaatcccaaaatagattttcgttaccagttagatcaatcaaacgggtgtataattcgctagtcagccggatgacactcatactgatctggcctagaagaacgatcaataaaaaccaatgactgactcgggggtgaccaataattttccaatttttctttttaaacatttagttgacattcttaggacccgcgttatttgttgtctggccttgtgtgtaggctaataaatgatcacgtaagtcattttccatgtggtttaattctttttcagccatttgccgtttttcgtgaccttcttgttgaatcttcaaggtttcttgaagggtttcgactaagtcgttttgggtcttttgaagggtttcgatatcaacgacgccacgttcgttttccttagcagtttcaattgatgacatcttcaacatcgcactatttttcttcaagagatcgttagttgtttcggaaacttggcgttgtgcagtgaccgcatctttttgacggaggagggtcaaggcgattgcgacttgattcttccaaagcggaatagcggtgttaattgaggcttgaattttttcagcgagcgcttggttcgtattttggattaagcgaatttgtggcgcttgttggagcgtaatttgacgggctaactctaaatcataagtccgcttttcaagccggttcttaaattgattgagatcattgacctcttgcacagccatttgattgttgtcattttcggctttcgccatagcagctgggatctcagtttgatcgagcgcttgcatcttgagttgaccagcggcgatgtagatattcagtgcatcaaagtaggctttgtttttagcgtatagaccttccaatgtttcgttatcgcgcattaaaccgtctttttctttttccagtttaatcgcaatcccgtcgatttgagcaccaatcttttgatacttagcagtgacttcgtaaactgattttttaatcttaccaaacatccgcttgaaaacgttgctgtcttcagcccgtaattcgtccgggttagcttcgtttagacgatacatcaatgaagttagtgcgtcgccgatttcaccagtttcttggctttgaacttgattcaacattgtttgcgaaaaagcacccagtttcttttgggcctgagcgccgtaattgagaactgcttgttgatcgttaacgtctaattgttcagccaattcttgggcttgttgttgttgttcaggtgagagttggtttagtaattcttcacctgattttttttcaaccgtttcttcagtaacggcaggggtcgcttgatcaaatgggtcttttaataaatcactcattaaatcatcttgtttttcggtaacgtctgtcatttagttttcctccttgtgatcaggggttgtttgttgttttgcaactgagatttcagtgtcgagatcatctaaatcatcggccacaaaagtcgcgtagtcttgcttaatttgttggctcaaagcatcgattgcttcggcagatttatccaaaacagcgtaggtatcagccgtcttaacttcatgatgactaatctcgatgaatttgcgcgttagttcattaattgaaggtaagtgacgatagagaaaatcgctagctaagtgcaagcgtttgggttccttgacgattgcttggaacatggcttgactgacacgcgttgtttcttgatttaaatcaatcgcctttaatttaggaagagcttgcatgttagttgccaaagcttgaacttcaatttcggcttggtgcattgttgatctgaagaaatcaatctcatcatcactcatgccggcatcttgatagtgtttcagcattttatctgaaattttgtgattggttttgtattggggttgttgcttaaggcgtttaaaactgattagcatgtagatcgcagcgagtaagacacctagaccgacccacaagaagttatcccaatcgccatagaaatcaaaaagagttgcgaacgttggaattgaaactgccataattagaaagccaatacaccatatttttatttttttaaacatatgtcttatgaggaaaaggtattatccgaagaaacactttttaaagggcatgtgattgatctagcggttcaacaagttgccttgccagatggtcaaaccgccagtcgcgaaattgtctatcaccatggtgcggttgggattattccaatcacagctgatggtgagctattattggtacgacaatggcgcgcaccaatgcaacgtgaaacgcttgaaattccagcgggaaaaattgatctaggtgaaacggatttggccaaggttgctttacgagaattaaatgaagaaacaggcttaacgacggctaatttacaacaaattgctgaattttttacatcaccaggtttttctaatgaaaaaatgacgctcttttatacgacggctctaaccccagttgctaataaacgtccgttagatgatgatgagtttttgaacgttgaacgcttaacactcgcacaagcgcaagcagccgttaagagtgggctcatttgtgatgccaaaacgattatggcactatactactggcaattacaaagcaaatagatggctaatgaaccgagtacgcgtgaagcttaccgccaacaaaaagaggcggaagaagcggcttttaaacaacgcgatcaagaacggttaagaaccgaacgggaatatgcccgacaaaagcaaaaggcggctttcaaggctgtgaccgatgacgctccggaaaagaagcgtcggcgtgagaaaaaagaagatctcccagcagttaaacgattgaagactcgtttgaactgggcgattgggattacatttggattaattataatcgtttacttgatcttatttttcatataaatgaaaattagtgtcgtttgtgccatggaagaagaaattcggacattgttaacgaagttagaagatgttcaagaacatacggtggcaggcaataccttctataaaggacaattgtacggtcatgaagtcacgttagttgaatcagggattggtaaagtacaagctgggatgacaacggcgattttattagccgaagaaaaaccagatgttgttatcaatacaggttcagctggtgggattggcgaaggcttacacatcggtgacgttgtgatttcaagtcaagtcgcatatcatgatgctgaagcaacggcctttggttatttaccaggacaattaccacaacaaccccaacgttttgaaggggatgctaacacagttaaacaaattgaagcggctgccaaagcagttgacttacaaccacgtgttggtttaatcgtcacgggtgaccaatttatcgccagccaagataaaatcaaagcgattaaggaaatctatccagaagccctctcttgtgaaatggaaggcgcagcgattggccaagtggcaacccaatttgggattccattcgttgttatccgtgctatgagtgatgttggtgatgaggatgccggtgtaacgtttgacgaattcatcgtagaagcaggccaaaaatcagcagcaatgctcctcaacttcttgaagaatattaaataaatggaaaaattttgtcaaagttgtggcatgccactttcaccagccaaccaaggtcgtgaacaagatggcaccaaatcaacgcaatattgccaactttgttacattgatggtcaatggacagaaccgacaattacttttgaacagatgttagctaaaggtatcgcgggtcttcgtgctgatcaaacaaccggtcaattaaaaaaatggttcttaattaaaagctatccgatgatgctcaaaaaaatgagacggtggcaataaatgacatcagaggttgagcaatattggcaaacgtttattaaagaacaaaatttatcacctgaacggcaaccagcagaaatttattcatttggaaatacagtgcaaatggctaatgaattagcggtactagtcattagtagtcaaaaaacggcaactacttcggccattgacttgtatgaacctaatgagcatgtacctcaggctggtgattataatattatattagatggacaagggaaacccgctgcgattactaaaacaatgagctgtaaaattattgcttataataaggtatcggctgatcatgcttatttagaaggtgagggtgatcgaacacttgattattggcgagcggttcatgaacctttttttacggctgaatatgccgagttaaaccgaacatttgagccaacgattccttgtttatgtgaacaatttatggtggttaagtcttagatgattcccaaacgattatcaaaaggcgatgaaattcgggtcatcgcacctagcaatagtttacaaagtgtgggcgggtttaccgccaatcaagcggcgctcaaacgcctaaacgacctcggttatcaggtaacatttggtcaaaatgtgacggtaatggactgtcttaattcaagtccaattgaggcgcgtgttgctgatttacatgccgcttttttagatgataacgttaaagcaattttagcggtgactggtggttataatgccaacgaattattgccatatctcgattttgaattgattgctaaacaccctaagattatttgtggctactctgattttacatcgttggccaatgcgattaccgctaagaccggcttagtgacctattacggcccgtcttacatcgcatttaaattagcggatcaactcggtgattatcaagttcaaaattggtaaatgactcagggcacggatacggttcggttgactgcatctgcccaatggtcaagtgatgcatggtacttgccggatgctaagcgcgactatcacgacaatcaatggcagacatatgccaaaggccgcgtaacgggtgagttagtggggggcaacttgaacacgctctacaccttacaaggaacgtcttatcaaccaaattatgatcgtaaaattttattgatcgagtgttcagatgattctgatcgttacgatttttcacgtaatctagcggcactcttacaaagtattcgacagccacaggcgctgattatcgggcgaatcccgacggatgttgatttggatgaagaaatgctcttatatattttagcgaaatttccaattttaaaaacgataccagtactctataatgtcaatgttgggcatacgcaaccgattctgacattaccaattggtcagacaattacggtggatgcgacggagaaatgggtacagattgaaaatgatagataaatggatttgtatggcgtgttattcataataacattgatgatatttttaccggagcgttatcgagattatgtttatcttaaactaggctattatcggtatttaatccttttagggctatttttagctttaatagcgacgctcgttagcaacgaattcttcgtctttattccgatggcgattattttatcctgtttggttgcttttttagattttagaagttttaaaaaatttatgaatcgaaatgaataattataactgtcttaaagctgccattagggctggttgccgttgaatttccgttagcggtaaatcattggtaatttgatggccttcgttaaaaataacaattcgcttagcgatttgttgcacctgttcgtagttatgactggcaagcaaaatgcttttgccagcctggttcagctgttgtagtagttgaactaatagtgtctgataagctgccgataagccattaaagggttcatccaaaataatcatttcgggattcattgttaagatgctccctaatgcgactaatttcttttcaccaccggatagttgataggggactcgatcggcgagtttttcgatttgaaggagttttaagcagtcttgcacacgggtttgaacggcttctttagacagacccatctgttcaggaccaaaggcgagttcggcgaaaaccgtttcgttgaagagttgcacatcactgttttgaaaaacaaagccgaccgcacgatgtaaggcggtcgtttgaaccgcattttttaaaaattgatgatcaactaactggtccttaaagtaatattggccggccgttggttcgattaagccattgattaatttgaataaggttgatttaccagaaccgttgggccccataaacgcgactgcttcaccaggctgaatagtgagcgaaatatccgttaaactatctgtttgggtgtaggcatagtgaatgtgattgagttgtagcatttacctccgaatgaaacagaatagacaaatcaaggtgagatcccaactgattaagcgccaatcgtagcgtgtaatggttaatgatgcttgttgattaacatgaccagtataaccccgtaaaagcatcgcttgatataattcagtcatataagctcgtgcgcttagatagagtcgaccaatcaaggaaccgactaagtgctgtcttttttgcgctttaccggttgaacgcaagcgtattgcccaaagtgattcttgtaaaaattgtgctaataaatggctgtatttaagactaatttctaaagttaaaactagcagtccgggtagtttaagttggcgtaaggctaaaataaacgcaggccaggtgattaactgtaaaaaaaagccaatattgaataaaataatctcggtacgaataataaaataccaagtcgtttcagcgtgaccgagccagaaattcggtaaaattaacgcaagggcgactaaactaatgctagcgactcgctttaaaagtggtccaatttgctgacctggtaagacacaaatacggataagtgttaataatccgattagccaaatgagtaaaaagctatgtgtgagtacgacgattaaaatggtaatgagtaaactaagcaattgaataccaggtgtttgccgagttgattgatgtcggatggttggttgggcgagtcgtgacaaaatagccgtcagtaaccgtaaattttgaattaaaaaacggtcgggtttagcgaccgtttggggaattatttctgttttgttgagccaatcaggcagtttaggcgtgggttgcatttaggcgtgggttgcataatgattaatcaccagttttccaatgagatagaagataaggaccgctgtcagtgcggatagcatgtaaccaagtggtaggggaagcccttgaatcgcgtaatcgctaaagagtgcattaaagtttaagccatgggccataccggtcgggaggacttggctaagatgggctgtttttaattgttgcaagagttcacttgcgtcccattcaccccaagcagtgccacttgctaataaaccaatcggtgacaaaataatcaaaccaacgataaaagtataaagagcgcagtgtagttttttagttggtgttactgcggtgagtttttgaggggcagcgtaaagttcgttaggggcaacttttttgatgaattgatagaccgcaaccgtgaaaccagcttcaacccaaccagcgattaataggtgggcgaataacattgctggaatcgcaatgtgtagcggataaggggcataaagtggttgaccagctgcgtcatgggcgattaagggctgtaagccaagttcaattcccgccattaaagccgccgtgttgatgcctagataagcaccaaggataacacccaacttttcgtgatgccttttttgaaaaagtcgataaataccataaccgacaaaaggcataacaacagccatattgaagacattagcacctagcgcgaggatcccaccatcgccaaacaagaaggcttgtgtcactaaagcaagtgtaaccgataaactggcggcatacgggccaatcaggatggcgagtaaagtagcaccaacggcatgggcggttgtcccaccaggaatcggcacgttaaacatcatcattaaaaacgaaagagaagcggagatgcctagcatcggcaccgtttcttttttttcggcaacttgtagtttaaccttctttagtgccaagccaacgattggtatagtggcagcaaagaaaaaagtacaggtttgtggacttaaataattatctggaatatgcatctagttggcaatgttgtctaatagataactgacatccttaattaaaaatttgtggccgttagtttgcaagacaccatcttttttaagctgattgagcattctattaacactacttctggaactaatgccacaaaaaccagcgatatcttcgttagtgactacaaaatcaatcagaataccgtctttttgtttgatcccaaataggtcgattaggtcgtataagaaggcacaaagcccgccttttttaccattcatcatcattttttgcaggcgataaatattttcggataattttttgcgatagtaatttttaatgtagttttgcaattcaggggtggtgttaacgtagtgccagaaggtgacccgatcgatttgatagaaggttgcttcttctgattcaatccggacgttaaagggttggtcggtgtatttagagacctcatcgcgaaggagcgaaataacgtcaggttgcgcgatataagataagttaaattcacggccatcttgtaagataatcgaatttttgataatgccgtttttcaatatataggtataacgttcctctagaccatgataggtcagataagtatgtcgttttttggtgataattgggacttgtcgatcctctaaaaaattaattagaaattcaatatcatttaaaaccatttggtagctataaaattaccttacgatcaaaaaattattacggctaatattgcagatgctaattttgccggcaagttggtttctcaagcagccacttatcaaaatccattgagtgaggccgaaacagttgaacagtcattggataatcctattgatagtccgaagttggaagaattggcgaagggaaagaagaacattgtcatcatcagttctgaccacacccgaccagtaccttcacatattatgacgcctattttattaagacggattcgttcagtggcacctgatgcacgcattcgcattttggtggccaccggatttcaccggccttcaacgcacgaagaactcgtcaataagtatggtgaagaaatcgttgctaatgaagaaatcgtcatgcacatctcaactgatgatagttcagtggttaaaattggccaattaccttcaggtggcgattgtattatcaataaaattgctgttgaagctgacttgttaatttcagaaggtttcattgaatctcatttctttgccggtttttcaggcggtcggaaatcaattctaccgggtgtggcgtcatacaaaacaattatggccaaccactcaggtgaatttatcaattcccattattcaagaactgggaacttaatgcataatccagtccacaaggatatggtttacgctgctaaaacagccggtcttaaatttattttgaatgttgttttggatgaagataaacatatcatcggttcttttgccggtaatttagaaacggcgcacaaaaaaggctgtgacttcgttgaaagtctatcagaagtcgacaaaattgattgtgacatcgcaatttcaaccaacggtggttatccacttgatcaaaatatctaccaagcggtcaaagggatgactgctgctgaagccacgaataaacaaggtggcgtaattattatggtcgctggtgcacgtgatggtcatggtggcgatggtttctaccataatattgccgacgttaaagatccaaaggaattcttagaccaagcaattaacacaccacggcttgaaacggtgcccgatcaatggacgtcacaaattttagctcgaattttagtgcaacatcacgtgattttcgtatcagatttagttgatcctcaattaattaccgatatgcatatggaactggcaactagtttagatgctgccttagaacgagcctatgcaattgaaggtgtggacgcaaaagtgactgtaatccctgatggtttaggggttattgtgaaataaatgagtagtttggacacaacaaatgagctacaacagctattagaagccgttgcaaaccaaaaagtcagtgtaaaagaggccaccaagcagctagcgcatgaacagaccatagatgatttaggctttgccaaggtcgatttaagtcgccaaaaacgtaatggctatccggaagtaatctatggtgccggtaagacggccgaccaaattattggcattatcggctctttaaaacggcatgctgaaaatattctctgtacgagagtatccccccaaaagtatgcggtaattagagttgccgaaccaaccgcccattatgatgaattagcccagtgtgtcactttaatgttaacgccagtagaacaaactgagcattatattgctgttgtgacggccggcacttccgatatggcagttgccgaagaagcggccgttaccgcagaggtttacggtaaccaagtaaaacgaatttatgatgtcggggttgctggcattcatcgtctttttgaacatttagatgagattcgtgaggcccaggtcgtgattgtggtcgctggcatggaaggcgccttagccagtgttgttggtgggttgattgaaaaaccactgattgccgtccccactagcatcggttatggaacgaactttggtggactaacagcgctgatgacgatgctcaatagttgtgcttcaggcattacggtcgtcaatgtcgataatggttttggcgccggttactcagcaagtatgatcaatcatttaagtgagacggaggatgacaaatgaatgagaacactttatttagacgctttttcagggattagtggtgacatgtttattggcgcattactcgatttaggggttgatttcaagcaatttgagaccgaattggccaagttaaatgtgactggttaccacttgcatgcccagcggatcgctaaaagcagtatctatgggaccgattttgatgttcatttgccagaaaccgtgcacaaggatgaaggctttattgaaaccacatcaactcatcatcatgatcatccacaccaacatgcagatgggcacacacatagccatggcgatgaagttcggcatttaaaggacatcgaagccatcattgatcacagtgatttaagtaattatgttaaaaccaatgctaaacaagtttttacggaaattgccaaatcagaagcgatcgttcacgaattgccgctaagtgacgtccattttcatgaagttggtgcgcttgattcaattgttgatattgtcggtgcgtttgtcgcactcgaattattggcagtcgatcaagtttattcatccgaattaacggatggcagtggctttatcaaagtggcccatggaatgatgcctgttccggtaccagctgtgatgcaaatgcgagtgggcagtgcgattccgattaagcaaaacccagagattcatacggaattgattacaccaacgggaatgggcattgtcaagacgattgtcgatcaattctgtccaattccagacaatcaaacgattactaaagttggttatggctttggtaatcgggaaacaccacaactcaatgcgttacgtgtgatgttgtgcgaaaaaaaaaactaagtgcgaaaaaaaaaactaagccaacgggttgttgaagaaaaggcagaccagatattagtgttggaggccaacattgatgatcagtcagcggaaagtttagcgccggttttggatttattgatggataatggggcgctcgatgcctttttcagtcctattcagatgaagaaaaatcggccagctatcaaactaacggtcatgattcatccagccgatcagcaagccattacttatctgatcttgaaacatacatcaaccgttggcgtgcgttaccagacaatggggcgcaccatcatgccacgtcattttatgaccgtcacaacgagttatggtgatattcgggtcaaagtagttaattacgacgatattgaaaaatatacgccggagtttgacgactgcttagcagccgctaaggcctacgacgtggcgcttaatcaagtttatctcgctgtttatcagcaattaaaataaatggttcatcagttattagcagaattcatgggcacagcgctcatgatcattttcggggttggggttcatagtgatgaagtcctaaaaggatcaaaatatcgtggctcaggtcatttatttgcaatcacaacttggggcttcgggattacagtagccttattcatcttcggggatgtctcaattaacccagcgatggtactagcacaatgcgttttaggcaatatctcatgggcaatgttcattccttattcagttgctgaagtattaggtgggattgtcggtgctatcattgtctacattatgtacgccgacgaattcaaagcttcagaaggcaacgtcgatccagtcgctgttcggaacatcttctcaacagcccctggtattcgtaatttaccacgaaatttcttcgttgaattttttgcaacatttgttttcatttcatcaatcatcgcgattacacaaattaagacaccaggaattgcaccaattgctgttggattacttgtttgggcaattgggatggggatgggcggtcctaccggattcgcgatgaaccttgcacgtgatatgggtcctagaattgcgcacgctattttacccattaaaaataaagctaactcagattggcaatacgggattattgtacctgggattgccccatttgttggtggtctatgtgccgcactcttcatgcggagcttctttggtatctaaatgcgggaacaaattaaacaaactcaaacgatgatggtcgatttatttgaagtcgctgcacatgcgtcacaaccagggacaatttcaacgagtcttatcgaagcgcaacaagctctcttaacagcggaacaactatacggagatttagatgacgcacaacaaagtgcgggtcaatcaacattcaaacactttgttgatagtgccacagatttgaatttaatgattgtcaaaagtttagataacaatgatttagcttatgctgatcggattcaaaacggtttatcagaattaaaacaattaatttaaatgaatacattatctgaaaaaaaagcaatgttggctgccaatttacaacaaatgaaaaaagtaatcgtagccttttctggtgggattgatagcacattagtattaaaaatggctttagaaacactcggtaaggaaaatgtcttagcagtcgttgctaactcagaattattcacagacgaagaatttaacaaggcaatcgacttagcacatgaaatgggggctaacgttgaaacaaccactttaaattacttatcagatgaacatattgctaataacacaccagaaacttggtattacagcaagaagatgttctacacacaattaaaccaaattgctgctgaaaaaggctttgatcacgtcttagatggcatgattatggatgacaacagtgatttccgtcccggcttacgagctcgtgatgaagctggtgcagaaagtgtccttcaaacagctggtttctacaagattgatgtccgccaattagcgaaagaattaaacttgaataactggaacaaagtggctagctgttcagtttcttcacgcttcccatataacacagccttaacagaagacaagattgcgcaagtcatgcaatcagagaaattcttgcgtgatttaggttttgcaacggtccgtgttcgctaccacgaatcaattgcccgtgttgaagtgccagaagcacaaattgctgactttttaacacatagcgaacaaatcaaccaagctttacaacaagctgggttcgaatttgtcactgttgatttagctggtttcaagagtggtcggatgaatgaatcactatcagaacaacaaaaagcagccttgatgaccgcataattggaacatatttatttagacaatgcagcaacgaccccgattgccccggaggtaatcgagacgatgaccacgcagatgacccaagattttgggaatgcgtctagcacccatttctttgggcgtcaagcacatactgttttagatacaagtcggcatattctagcgcaaagtattaatgcgaaggataacgatattattttaaccagtggtgcaactgaaagtaataacatggcgattttacaaacggctcaaaaacgggctaacgaaggtaaacggattattacgacagcgattgaacatcattctgttttaaaaccaatggcttatttagaaagccaagggtttgatatcgtttatttacccgttaatgcacaaggcgttattgaattggctgacttaagggctgccttaacacctgaaacgattctagtaacgattatgatgggcaataatgaaattggcagtcatatgccaattcacgaaatcggccaacttgttcatgaatcaaatgcctggttccatacagatgccactcaggcatatggtttattggacatcgatgtgcaagaagatcagattgatatgttatctgtttcagcacacaagattaatgggcctaagcaaattgggttcttgtacgtgaatgacgcgattcatttgccatcatttttaatgggtggcgaacaagaaaagaaacgccgtgcggggacagaaaatattccagccgttgctgggtttgccaaagcagttgaattattgacaccagctgttaaggctgaacatcgcgctcggtatgctggtttcaaacaacaagtcttagaaacccttcaagcaaacggtattgactttgaagtcaatggcgcaggtagtgacgatatggtgggccacgtattaaatatgtgggttaagggtgtctcaacctatgtcttgcagatgaaccttgatttagcaggctttgcgatttcaggtgggtcagcatgtactgcaggtgatttggaaccttcacacgttctaattgccatgtacggtgaagatagcccacgagttgccgaaagtattcgaattagttttggtgttgagacaactgaagcagatgtgactgccttttgtgccgcattaactaaaattgtgcaaaaaaacttggctaagcaagccggtaaagcctagatggctttattaaaagagacagcaacggttttaggcaatacgacacaatatgggttaagtgacgccgttaagaaatatacattacgagatactggcttcatgccaaccaataatggtaattttcaattggaacggccccttgatcctaattcaccctttaatacagcgattaagcttaaaattactgttggtaaagaattgaagacgctcaaaatgtcggtcacttccgctgatgggttacatccagttaatatttttaaggatgaaaagaacgctgaaaacgtcgaacaatttaatttcattattaatcacttgattgaacgggatattttggtagcccaagcataaatgagcggcggagtggactcatcagtaacagccttattgttaaagcaacaaggttatgatgttattggtgttttcatgaaaaattgggacgatacggatgaaaatggtgtctgtaccgcaacggaagattatgaggatgttgccaaggttgcttctaaaattggcattccttattattccgttaacttcgaaaaggaatactgggatcgcgtgttcgaatatttcttagacgaatataagcacggtagaacacctaatcctgatgttatgtgtaacaaagaagtgaaattcaaggctttcttagattacgcaatggaacttgatgctgactttatcgcaatgggccactatgctcagatcgaacgcgatgaaaacggcattgcccacatgttgcgtggcggtgatagcaataaagatcaaacatacttcttgagcgctctttctcaagatcaattacaaaaatcaatgttcccaatcggtcacatgcaaaaatcagaagtccgtcgtttagctgaagaagctggcttagcaactgctaagaagaaggactcaactgggatttgtttcatcggcgaacggaactttaagcaattcttaggcgaatacttaccagcacaaccaggtaagatgatgactgtcgacggtcttgaaaaaggcacacatgatggtttgatgtactacacaatcggtcaacgttctggtcttgggatcggtggcggtggcgaatcaaacgacccatggtttgttgtcggcaaagacttagagcagaatattctgtatgttggccaaggctaccataacgagttactctatgctgaccaattggatgcaagtaagatgacttggatcacaccagttgatcacggcacagatttccattgcacagcgaagttccgttatcgtcaacaagatgttggcgtaacagttcacatgacttcagagacaactgctacagttgtcttcgatgcgccagtgcgcgctattacacccggacaagctgttgttttctacgacggcgcagaatgtttaggtggcggcacaatcgacgtggcttacaaagtcgctaccgatgatgctgacaagcaagttttacaatacgtctaaatgaacttagcaaaatatatcgatcatacattattaaaacctgaggcaacaatggctcaagtagaccaaattatcgcagaagcaaaaacatatcaatttgcatctgtttgtttaaatccatattgggtgaagcgtgctagtgaggcacttcaagatagcgatgttaaagttgtgactgttattggctttcctttgggtgcaacaacgacagctactaaagtttttgaagcacaagatgccattgagaatggcgctgatgaattagacatggtcatcaatgttggtgaattgaaagcgggtcacgatgaacaagtgctaagtgatattcaagccgttgtcaaagcaggccatgctgctcaaaaacacgtgaaggttattattgaaacttgtctattatcggatgaggaaaaacgacgtgcttgtgaattatctgaaaaagcgggtgctgattttgttaaaacatcaactggtttctcgactggtggcgcaacggttgcagatgttactttaatgcgttcagtcgttggcgatcggttaggggttaaggcatctggcggtattcattcaaaagaagatgctgaagcaatgattgcagctggtgcaaatcgattaggcgcaagtgccggtgttaaaatcatgaacagtaaataaatgcaattcaaacgggtttttacagttgtcttagattcagttggtattggtgaagcgagtgatgctgctaactttaatgatgtcggtgccgacacacttgggcatattggtgcgttttacggtgaacaatttaagttacctaacttacaaaaattaggattaggtaatattcgtgcatctgatccgattaagggtgtccctgcggcgcaaccagctttgggttattttggtaagatgcaagaaacttcagttggtaaagatagtatggatggtcattgggaaatgatgggtttaccagttaaagaaccacttggctttttccccaatggctttcccaacgaattaattcaaaaactagctgcttttagtggtcgttccgtaattgttaatcggccctattcaggcactgatgtgattcgggattatggcgaagaacaactcgcaacaggcgctttaattgtttatacatcaggcgattccgtcttacaaattgccgctaatgaagcggtcattacgcttgaggaattatatcgaatttgcgaatatgcccggcaaataacaattgaaaagccataccgaattggccgcgtcatcgcacgtccgtttaaggggcaagacaaagaccattttgaacggacctcagatcggcatgattatacattagaaccaactgggacgactgatatggatcgtttgaaggcagctggcttggatgtccttgcagtgggtaagattaatgatatcttttctggtaaagggattacaagcggtgtccatacagaaagtaatcacgatggaatggtccaaaccatcaaaaatgcacaaaccgatttcaccggatttagttttacaaatttagttgattttgatgcgatgtatggtcatcgccgtaatccagaagggtacggggccgctttaatggcatttgatcaacaattaggcgaattactagctgttttaaaacccgatgacttgttactcatcactgctgaccatggcaacgatcctggtttcagagggactgatcatacgcgtgaatacgtcccattgttagcttattcatctcgtttagcagggaatcaatcacttggcgttcgatcaacttttgccgatttaggggcgacgattttagaaaactttgattgtccagcaggagaagttggtacaagctttttaacacaattaaaataaatgagtacacatattgaagcccaacaaggggatattgcggaaactgttttattgcctggtgatccattgcgcgctaaatatatcgctgaaacgtttttaacagatgtgcaccgctataatacaattcggaatgcatttggttatactggttattacaaaggacaagccatttcagtccaagcttctggtatggggattccatccatctcaatttacgctaatgaattaattcaattttatggtgttaaacggttaatccgcgttggcacttgtggcggattagggactgatgttcacgtcagagacgttgtgattgcccaatccgcaagtacagattctgctattattcaaaatacatttggtgccggattgtattatgcaccgacggctgattttaaactcttaatgaaggcttaccaagcagcccaacaagcacgaattgcggttaaggttggtaatatcttgtcagaggatcgtttttacaacgatgaaattgatcgacaaaagctaatccaatatggtgttttaggttctgaaatggaagccgcggcactttatatgttggcagcgaagtttaacgtccaggcattagccgtgttgacgattagtaatcacatcattacaggagaagaaacctcagctgaagaacgcgaaaaatcgtttaacgaaatgataacggttgcattggaagctggtattgcttaaatgtatcttttagtgaatattatcggtttaattgtctttgtcggtttggcctttttattctcgaaaaaaaagtcgcagattaaatggcgttcaattggcattatgatggcaatcaatctttttctagcgtggtttttaaccggctttccgattggacgcaacatcgttatgggagcggccaatggctttaattggttggtccaagtcgcttataccggaattgcctttgctttaccaagttgggtagctgttaagcaaatggattttgtgacgagtgtcttgttaccaattctaatgattatcccgttattcgatattttgacgtatatcggtgttttaccatggatcattaaatggttagggcgtggcttatcaaaagtaacgggtcaaccaaagttcgaatcattttttgcagttgaaatgatgtttttgggaaacactgaagctttggctgtttcagcattacaactcaaacagatgaaaggcgaacggaacttaacgttagccatgatgtcaatgagctgtgtgacggcatccattattggggcttatacacaaatgatgccggggcaatttattttaaccgcgattccaattaatattattaacgcaattattgttactaatatcttgaatccggttgaagtaacaccggaagaagatacgattgcaacgatgagtggtagtgggtctgatacttctgacgaacaagtagacgtacaagggaaagaacccttcttttcatttttaggggattcaatcttgaacgctggtaagttagtcttgattattacggccaacgttattgcctttgtggcattagccgctttgattgataaaatcttacaattgatcaatccttggattacattggaacatcttttagggattatcatgttcccatttgcttggttgatgggcttagatgttagtcacgcttttgaattcgcgcaatttatgggaactaagttagtgacaaatgaatttgttgtaatgggtaaagtgacaaatacgattggcgattttgccccacattacaaggcaattctaacggtcttcatgacctcgtttgccaacttctcaacagtcggcatgattatcggcgctttcaagggcttagtcgataaatcaaagaataatttaattgctaaaaacgttggttacatgttgctttctggtattttagtgtcattattatcagcagcgactgttggtttattcgtttggtaaatggcattccaggtgggacataaaaatcaagtgcgaacagaaattttagcaggcatcacaagtttcttcgcgatttcatacatcattattgttaatccaatgattttaaaggatgcggggattccggctaatcttagtgtgttcgccacgattttttcatcagcaattggctgttttatcatgggaatttgggctaaggccccaattgttttgacacctggaatgggcgttaatgcctttttcacgtataccctagtggttgggatgcatttgacttggcaacaagccgtggctatttcttttttcagtagttttatctatgtcgggattgcctttacatctcttagtgagcgtttatccgctttaatcccagcatcgttaaaagcggggattacggttggtattgggctattcctagttgttttaggactcgaaaaagccgaactgattcgctcgggcggtacacagtcgttgctcgcattaggtgatttgagtcaagcaacaccactgttagcccttttagggttgaccgttacgctcgtattgtatttaagacaaacaccagggagttttatcgtcggcattttcttaatcagtgggctcgcggggatttttaaacttgtcccacaagcaacaacccagattacgattagtcaaatccgtgactatccgcaacttttaatgcaaggtgattttagttctttatggacgctaaaatttggattggcggttttttcaatgaccatgatcttagtttttgaatcgatgggcttattagaaggtttattgaccgatcagcaacaatttaaacgcgcatttcaagcaagtgcggtaacgactttactctctggtttcttagggaccagtcccaccgttgcagctgctgaaagtgcttcggggattgaaagtggtggtcgaactggcatcacggcctttacggcgggcacattatttttaggcgcacttttctttattccgttgttgcgctttgtgccccaagcagccattgcaccagtcattattattaccggtgctttgatgatgatgcaggtccaagcaattgatttgcaagattttacagaatggtttccagcctttttaatgattgttttgatcccattaacaggttcaatttcaacagggttagcatttggtttcgtcttttatccaattgtgaagtgggcgggccacaaaacacgacaattaaattggactttagttggcttagcgatgctttttctattagaattgatttgtaatacttttttgatgtaaatggtagaaattgagtcgcataaaaaaacgcaacaaagtttagctgttgctaatttatattacaaagccaatatgagccaggaagaaatcgcaaaaaaactggcgatttctagaccaactgtctcacgacttttgcaatatgctaaagaaattgggattgtccggattgaaatcgttgatccttatgccagtgcacaagcattagaaacgttaattcaacaaaaatatgatttacctgaggtgcacgtcgtttatacagatgtctccgattaccaacaaacaattgtccaacttgggcagtatgcggcggattatctgacgtcgattgttaaagacaatgatttaatcggtgtcagttggggcaagacgttaaatcaagtggcgctagcactgaaagaacaaacggctcaaaacgttaatattattgaattaaaagggagtgtcacttacaccccaacaccggtttatgccgaagaagtcctgatgaaatttgggacggctttccatacagcgccgcatgtcttgccgttaccggttgtttttggcaaccaaacgacgcacgatgttgtcatggaagatcgccatattagacggatgattgagatgggcaagcaagcgaacatcgcgatttatacggtcggcacggttcgggatgaggccttactctttcaaacgggttattttaataaggaagaacaagctgtgctgcaacaaaaagcggttggcgatatttgctcacgtttttataacacgagtggtcaagtgacatgtgcagcgattgatcagcgaaccgttgggattcaactcgcggatttgaagacgaaggaacatagtattttagtagcaggcgggcaacaaaaaattgcggctattaaaggcgcattagcggggcactatgcaaattgtttaattattgatgtgcatacagcccaagcattgattgcccctgactaaatgagaatggttgatatcattgatcataagcgacaaggtggcgccctaacggcagaagaaatccaattctttattgatgggtatacagatgggacgattccagactaccaagcaagtgcgttactgatggcgatttattttaatgacatgactgatgacgaacgggcgttgttgaccatgacgatgatgcgttcgggcgatcaattagatctttcgatgattgacggtatcaaagtcgacaagcattcaactggtggtgtcggtgataagaccagtattccacttgcaccaatgattgcagcgttggggattccaattccgatgatttcggggcgtggtttaggccatactggtggcacattggataaattggaagcgattccaaactttaacatttcgttaacagaagaagcctttaaaaagcaagtggcggagattaaacttgcgattattggcgcaaccggtaatattgcccccgctgacaagaaaatttatgcactcagagatgtgactgatacggttgattcgattccgttaattgcagggtcaatcatgagtaagaagattgcttcaggcaccgatgcgttagtattggacgttaagactggttccggagcctttatgaagactgaagaagacgctaaggaattggcacaagccctcgttaacattgggcgtagtgtggggatgcaatgtatggccgttatttctgatatgaatcaacctttgggcaatgcgattgggaatgcgctagaaatcgaagaatcaattgccatcttaaaaggagaaggaccagccgatattacagaactaatcttaacgttaggcagtcaaatggtcgtcttggctggaaaggcaagtaccttggatgaagcacgtcaattactacaaggcgtgatcgacgatggtcgagcactcgaagcctttcgccaaatgattatttatcaaggtggtgatcctgccgttattgaaaatccaaaattaatgccacaagcacaatatcaaatcgaattacctgctaaagaaaacggttatgtgactgaaatgaccgctaatgaaatgggaattgccagcatgttacttggcggtggccggcaggcgaaaaccgatgagattgattatgctgtcggattagtcttacacaaaaaaatcggagaccccgttcaaaaaggtgagagtctattgacgatttatagtaaccgagaagacattgaagccattaaggacttgctctacgataatattaaggttggttcaaaagcgcaaaaagttactttgattcatgcgctaattcaataaatgaaagtagcagtaattggttgtacacacgcaggaacctttgcaacacaagcaacattaacagcacaccctgattgggatgtcactgtttatgaaacacatgataatttatcatttctatcttgtgggattgcgctttgggtaggtggccacgtctctgatcctaaaaaaatgttctattcaagtccagaaatgttagcccaattgggtgcacatatgaagatgcaacacactgtcttgaaggcagacttgaaagagaaagtcttacacgttaagaacttagtgacttctgaagaaacaattgaaaaatttgataaaattattgtcacaactggttcatcaccagtgattccaccaatcgaaggtattgataatcccaacgttaaattatgtaaaaactgggaacatgctaacgaattgaagaagagtgcacctgatgtgaagagcgtcattgtcatcggttctggttacattggtgctgaattggctgaagcttatgcgacaactgataaaaaagtaaccttgatagatgctttaccacatgcacttggtaaaaactttgatcctaatatctctgagattgttgaacaagattacagagatcacggtgttcaattagccttaagcgaaaaagtagttagcttctcaggtactgatcaagtaactgttaagactgataagaacgaatacacagctgatcttgcaatcttatgtgttggtttcagaccaaatactggcctcttcaaggatcaagttgaaatgctaggcaacggtgcgattacaactgatgaatatatgcaaacatctgttaaaggtgtctatgctgccggcgattcagctgctgtatactataacccaacgcaaaaagcagattacattccattggcaactaatgctgttcgccaaggcttgttaattggtcgcaatatcgaaacaccaactgaaaaatatatgggcacacaagcaacatcagccgttgaattgttcggtcggacatattctggtagtggtttgacagttgaaggcgctaaggtccgcgggatggcagttgcaacaactactttgactgaagattatcgcccagactttatgccatcaacaacacctgttttgatgaacttaacatgggatcctaagacgcgccaagttttagggggctcatttacaagtcaatatgatattgcacaagcagctaacgtcatttcaatggccatccaaacgaagatgacaattgatcaattagcaatggttgatatgttcttccaacctaactacgatcaaccattgaactacgtcaacgcaattgcaatgaaagctgtcgctgaaagtcattaaatgacaaccttatattttgtacgtcacggtaaaactgaatggaatttggcagggcgctatcaaggtgcgaatggtgattcaccactactggcttctagttatacggaaatcggtgaattagctaactatttaaaagacattcagtttgcccatctctatacaagtccaatgaagcgcacgcgcgtgacgtcagcaactcttaaacaagatttacaccaagattttccaatcacggtggtcgatggcctccacgaatttgaccttggtttaatggaaggcatgtattttactgaagttcaggaacgtttcccggaaacgttacggactttccgcgaagcaccagctgaatatgatgcgagcgtcattaatggtgaaagcttcccgcaagtaatcaaacgtacaactgcggcgattgcgcagattatggccacggctaaaccagacgatcagattttaattgtgagtcacggagcggcattagttgccatgattcaggcgttattaaaaacacccttggcagatattcgtgcccacggtggtttaacgaactcatctgtcacaacgttaaaaacgactgatcaaggtcagtcatttgaactattggattggaacgaaacggcctttttaagccgcacactttctgcgtcagataccatttagatgaaacccgaaattttaaaaaaatgggcagctggccaacacgaagaagccgttcaacagctagttgattatttagaaaaaacacccactgatatcgaagcgtacgtcacactagcgacttttttgacgaccctcaaagattatgaacaagctgaagagcttttacaaaaagcgctaacgcaattcccagaaaacgacgcgctccaatatgcactcgggacactctattatcaagctgaagcttatcaacaagctgagaccactttctcgcaattggtgaaggagacccaagcactagatgcgcaatatatgttggcacaaacttatcatcaattggaacaaaacgctcgggcaatggcctttgcactcactattcaggaaaaacaaccagatcaattagatgctaatatcctagtcggtaatattttgattagtttaggcgattttgatcaagcacaaacctactttaaaaatgcacatcgcattgacgctcaaaacggcgaagcagttttcaaatatggtttaacgcagctagttcttggtcgagaaagccagtcatattttgaacgtgccaaaacattagatccagcatactttgaaaaaaataaacaacaactgattgatattgaaggctttatgcgcgccaaagatcagaaataattggaaacagaaaatacggtcgataataaaccaaccgttaccggaacggtccaaagtgttttttacgagaatcccggtaacttttttaagattctcttgattaaaattgcccataagacaattgattggcacgagccagagattgtcgtgactggtagttttggtgagattaaagaagacgaacgctatacgttttatggcaaagtcatcacccatcctaaatacggtcaacaatttcaagctgacaactatcaggttgaccaaccgacgactaagactggcttagtcgcctatttatctggcgaaaaatttgccggcatcggtcaaaaaacggcagagaagattgtcgataccttaggattagacgcgattgataagatcttagcggattcaaccgttttagcgccgctgggtttaaatgataagaaacaagcgacgttggttgaaacgttgacgattaataatgggatggaacaaattatcattggcctcaataattacggttttgggagctcgatggcctataatatctatcagacttatcacgaagataccttgaagattattcaagaaaatccttatcaactagtggccgacattgccggtattgggtttaaacgggcggataatttagccgagaaaattggctttgcagccgattcgccagcacggattcaaggggcgctgatgcaagccttgaacgaactgacaaatcaagcgggtgatacgttcactcaggcgaagccgttattagcagccagcattcaattgatggaacaggcacggaacgtggcgattgatccgaatttagtggcagagcaattaatggtcttggcacacgacggcaaagtggtcggagatgaaaatcggatttatccgaatggtttgtacaacgcggaatggcaaattgcgaaccacttgatgcggattgaaaatgaacgggataaaattagttatcctaaacatgatctggataaagaaattcgccggctcgaaaaacgttttaagatgagctatgatggtgttcaaaaaaatgcaatcaaattggcgatgacgcacagagcctttctactaacggggggccctggtacggggaaaacaacgattattaatgggattgtgactttatttgctgagttaaacggtctttcgcttgatatcaacgaatataaagacacaccattcccaattttattggcggcacccaccgggcgagccgctaaacggatgagtgaaacaactggcttgccagctagcacgattcatcgtttgttagggattacgggccgtgaaaataatcctgatatcgatagtaaggaactagaaggcggcttattaattgtcgatgaaatgtcgatggttgatacgtacctctttagatcgctgattcgagcggtgcctagcaatatgcaagtcgtctttgttggtgataaagatcagttgccatcagttggcgcggggcaagtcttttttgatttactgcagagtcaggcaattccggcaatcgaactgcaacaaatctaccgacaagacgatgagtcgacgattattccgctagcccatgagattaatcagggccaactaccagctgatttactccaaccgcaaaaggatcggagctttattcagtgcagtccttatcagattgaatcagtgattaaacaagtggtcactaaagcaaaagaacggggttttgagacgaaggacattcaagtgctagcaccgatgtatcgtggggcagccggaattgatcaattaaatccaatgattcaaaatatcatgaatccgaaggtcgatgatcgtaagaaacaagttagtttaggcaatgttcattaccggattggcgataagattttacatctggttaatagtccggaattaaacgtctttaacggtgaaattgggcaaataaccgggattacgtatgctaaagatagtgatgacaagatggacgagttaacgattgcctttgatagtaccgaaattacctataaacggacggaatggcataaaattacgttggcgtattgtacgtcgattcataaggctcaaggttctgaatttgaaatggtaattctaccattggttaaccaataccagcggatgctgaaacggaacttgttgtatacagcagtgacacgggcgcggtccttattgattttaattggggaaccaagtgcttttgataaagcagctaaggaattatccgcaaaccgacaaacaacgcttaaagaacggattatcagcgtctttaatggtgaaaaggtgagccaagcggtcaaaactgcaagtgttggtttaacggaagctaaaccggctgttgaaaagccaacgccggctaaagaagcggcgccagaacaattggcattagtggacgatgcagatgacagcgaagaaacaattcaagaagcacctgctaattatgaattaacaccagccttggtgagtggtcatcagattgacccgatgattggaatggcggatttaacgccgtacacattcatgacaagtgctaagtagatggctgaccagcgagctaatttagaaattagacccgtgacaatcgagtatttagaacaatttaatgacttattacgatatgttttccaggtaaccgatcaggaagtttctgatagtggttatgaagaaggcgaactagaacgtgctaaacggccggtcttagaaaaatcagatgtgattggttggtttaatggcgatgaattaatttcccaactcgcaatttatccttgtgaagttaatattcatggaaaaatttttaaaatggctgggttaaccggtgtgggcacctatccagaatatgccggccacggtttaatgcatgatttagtaaaagtcggcttagaccaaatgcggcaaaataaacaatggatttcctatctctatccttacagcattcctttttaccgtaaaaagggctgggagattatgtccgatcatctgacttatgatattcgcgatagtcaattacccaagcaacaacccgttaacgggcatgttgaacgtttggacattgacgatgctgatgtgattatgatgtatgataaattcgcgcttcgcaatcatggcgctatgattcgcaatgagttaaattgggatgaatattggcgttgggaaaacgaagaagaacggattgccggcgtttattatgatgaaaacgaagaaccaactggctacgtgctttattggatcgctaacgaagtcttccatattaaagaaatgatttatttgaatcaagaagcacgaattggtttgtggaactttatcggtgcgcattattcaatggtcgaccacgttaagggcaatctctatcaagatgaaccaattacgttcctattggatgatggggatattgagcagactattaaaccttatttcatggcgcggattgttgatgctaaggaattcttacaagcttatccgtttgaaacggacgggcaagccttccatattgaattaacggatccactagctgaatggaataacggcacatttggtgtttattgggacgagcaaggaaaagtccatgttacgagtcggccggttggcgaaaaggttgtttgcgatattcaaacgttgacgaccatgttaatgagttaccgacgcccatcatatttagctaaaattgaacgcctgcaggccacaaaacaaacgcttaaaaacttagagaatattattccggttgaacaaccttatttctcagattatttctaattatgaacggattgatatttcaataatatccgcactcgaataaataatattaggattgcgcttcgcaataaataaaggcgtctctttgatgaaatgcgttatgaacgcgacaatatcttgatggggaaagtccctaatagcaagtttattagtgcgcggcgcatccgctgctgttccgcataggacgtcatcatctttgagaacgatctttgtgttgtcgaataacgttaatttgaccatttaattatcctttgctatatcaatgtttatagcgtttttggggacatttggggacatggacaaaacgtccaacgctttatcagtttctgaaatccgttcttcttttagcatatgggcgtaaacttcttgagtgattgaagtgttggcatgacctaatctttttgagatatagttgattgaaacgcctttatataataaatatgatgcatgagaatgccttaaaccgtgaacactgagtttactgtaaatattaagcgatttagtaactcgctgtattctttttagagccgcttggtgtgtatgatcgaatattcttccagaactcccagaattaaagataactgcggttaattctttagtgattctaacatcgcgatatgagtttttgttttttggcggcgtaatttcacgactagcagctgtgagagatttatcaacatgaatgttattaaacggcgcactaacatcctcatagtttagcgctaaaacctcgcctattcgcataccagtctctaacgcgataagtaatgacaaattgattttgtcgttgctgtgggcatataaataggcttgtagtatttcgaactcatctgcggacaacgctttgatttttacgtcgctttccaaaccatggggtttaagtcgagaaaagaagtcggaagttatataaccgtcatataaagcgtctttaagagaggcctttatttttgcaaccagtaaagttaaataactctttttgtgagattctccatattcatctaatccgtgttggagtatagggtaatttagatcttctagccttacattggtaaatagtgtgtcgataatattctcagctgtgatataggccgttaaagttgacgctctaatatccttcgatttataatttttaacccacatcttgaagtaatcagaaaagagcatactagaagcaatgatctttttgttctgaaatttatccgactccatctgaacagaccattctgttgcctcacgcttggtattaaaagttttgctaactttgcgtcgtacacctttatccatgacagagacaactacacgccatttcttgccacgtttttcataacttgccatttagtcatttaagtgttggattgcataattagcttcatcaggtgtgaatttctcaccagcatctgatgttagctgttctctaatagattcaggggacatgttttgttgttcttgatagtctttggcagtagcaagagcatttgcattatagtcagcttttaaattgtcaatcgcatattgaccagcttccgctgagaatttttcgccagcgtcagatgttaattgttcataaagcccagatttcgacatgtgttgctgatctgaatattctttggccgtagccaatgcagatttgtattcagtagggactgattcgtcggatgaactagcagtagtgtcatccgagctattatccgtagtgtcgtcataatcatagtcgtcatcatcagaagacgacacatcgctggtcttatcgactgccttttcaacttttgagctagatgacgtcgctgctttattttcagcacctttcttaccgtcgttgtctttgttgccccctaaagcagaaccgccaacgattaaaactagtaccaccaaaatccaaaaccacacacgcttgtataccggtttcttttggacgtatgtattgccactttcgtccttaattttctttgccatctagtaatcttcaaatgaaacattaccactatcacgactcagcggtgtgattctaatttcaagagtagcgtcacgtttagcattaaatgcgtttgcgatggttgcttcatatttggcgaaccaaacattgccgtcttttgtccatggttgaatattccctaaaattatgtgaatcttgcttcccttataagggtactttttagaaaaagtttgatttgctaactgagttagaattgcagattgttcgtctgtcggtttttcactcaggcgagtaatatcgctagcttgttctgattcaactttagccttttctgattcggcttttttctggctttcagatgattctgacgctgctttttgttgactttcagaggctacagcagcgcgtgagctttcttgcgctaaactttctctattggccaaaaatttcttacttggttttacgtaaataagtttgctctttttggtgttatcgtcgtagtctttgctgacttcgagtcgaaggcttttcttgctgttgccttttaggttatattcaaaagaaaatttcccgtcagaatcagcagcggtttgtttgacattatcgatattaacgccatagtctggggaagtcttaccagaaatcgtcgcaacgcctttatcgttagtaacaaatgtttcgtttactgttaacttagtagacttgttgtccttatttgagtctgatccaaatccgattaataatagtagtaatgacaaaataccggtataaatccaccattgcttgaaaataggtgttacagagcttttgtcagctttgtatttttgataatacttaaccccaaaataaattgacactcccaaaagaatgaccgctccaacggtcatagctaaactaatcacgataattgcgactacaagcccgatgaaaaatttccaaatttgtttcatttatacatattcaattggcatatcaaattttgattcaagagttttgattgccttgtcactgaatatcattgagaagccaaccgtgcgttcttcacctgattcggttgtaaatataatgtgcgcgttttgcggcgatcgaactgtagttgttaacgcaggtttagtagttgaaacctttttagacgttgtaccaccaattatagcacccgggataccggctacgacacctccggtgattgcacgaccaacaacacttttactcttagttactgttttttctgttttagcttcaattgtatttgaattaaaaccgctccagtataaatgctcgaatttaagcatttcgtcaaagcctttaaattgatattttccattggcgtgttttattaattttaaattaccttcttgtgggtaatcgctaatcacgtttagcctaatctcatttgatgcaaaaagccccatttataaatctgttgtaaacctaattgccttgcccaaaattttagcagggttgtcggcggtgatgatgtacggattgtattcctgattatcgggaatcagtataataatattaccttggtgctttacgcgttttaaagtcgcttcggtgtcaccatttacaagcaccgcggctatttcaccgtcttctacttctggttgctctcttattaagacgttagaaccatttgggactgtcggctccattgagctgcctttcgccttaagatagaacagttcccccgaagggaggttctcagtggattcttctacataacccgaaatattttcttgtgcggtgattggatcgccacaggcaatctcgccaataataggaattcgaatgattgactttaccaaagaaatatttgaatcatcgttgaagccgagaacttccttagggtctaacccgagagcctttgaaaatgtgtctatttggtctaacgggaattgtctacttctgttttcgtaacgagaaatagaagacttcgcaacgcctgttaaagaagcaagctcattaattgaaatgcctttacgctttctagcttcaataagaatgttcataattccatcattacttctcatatgtcaatcaacttaaaaagaattaaagcagaacgtgtcgcaaaagggtttacgcaagaacaagttgcaaacaaaatcggaatgaaccgttcttcttatatcaaaagagaaaacgggaacgttccgttcggtgctgacgaacttgcaaaggttgctgaaatactaggacactattcagatattcagattttttttactctaaatgttcccaaacgggaacaatttatttaaatgaaagatttacaactattcaaattcaacggcaatcaagttcgaacagtgttaattgagaacgaaccatattttgtcggtaaagacgtagcagatattctaggttatgagcgttcagacaacgcgattagaaatcgggtcgatacagaagataagctaacgcaccatattagtgcatcaggtcaaaggcgcaacatgtacattatcaatgaatcaggtctatacagcttgattctatccagcaagctaccggctgctaaagaattcaaacgatgggtgacaaaagaagttctaccatctattcgaaaaaacggcgcatatctaaccatggaaaaagcggaagaaatcttattaaatccagatacgatcataaatttggcacaacaagtcaaaaatgaacggcaaggacgattgattgctgaacaacgggttaatgagctaacacctaaagcaacatattacgatacggtactggctaatgaagcgctcgtgtcaattacagttatcgcaaaagattatggtatgtcaggcaccaagatgaatatgttgctgcatgatttgaaagtccaatacaagcaaggtaaaacatggttattatatgccaaatatcaacgcaatggttggacgcaatccgaaacgcggatggttcagcgcaaagatggcacagaaaaagcagtccttaacactaaatggacacaaaaaggccggttagggttgtatgaactacttaaattgaacggcgtattaccaactattgaacaacaacaaacagcatagatgcaaaaccaaattaatagactagctaatttaattatccaagatattcgcgatgaagctatgcgccatggttccagctacaacgaagccgttgcttacctcagtgcaaaaaaagagaaacttcatgcgaattataaggataatcctgtttatggagttcaaattgatttaataaccaacgcgatacaggaattaaaaaaagaagctatgcagcttcctctgaaaaacattaaaaattaattaaaaattaagatcaatgtcatgcttatgcggatatgcatttagcatttcatcatgagaatcgcttaaacggtcaaacgctcccttaacaacatcctttggtgcttttgattgatagattcttaaaaatgactttgctttttcagtgactgcttcaaaagtgaaatcatcctttagctccatattattataaagattgtctttcatatccatcagtccttgtatgagtaggacatagccatctaatttagtagagctaaatgtgtgaattgatagttggtctactaatactctggaattttccacaagcatattagcaattgatattgcgtcatcttctacatcgaataacacatgtcaagaggtatcagccaattagacaaaccgcgcaaaccagattcggagtttccaatgttaatgactaaagagacattaggcggctatctaggcagagatgccagcatggttgattggcttattctaaacactgaattaggccggtcggcgatggagtatccaagaaaacaaacggtctatagcaaacttgtggttaataaatggcttgaaaaggagggctggtaaatgaactgggatatttacaaacaactggctgaccgctggtgcgaaggctacaagcacaagctatatattcaacaacaaaaggagcgagatcatggagaagatttacgtgaatgaatggagaagatttacgtgaatgatgacgagttaacagtattaagactttatcgcaagtgtgaccgagtatgtttcactaagcaccgtctgaacaagattgaagcgcaagagtttgcttcaatcctaggcaagccggactataccaaatacgacggtgcggagtgctttgggctatcaaaaggcaagattggcgttgctgcgttcgttaagcaaggaggcgcgtaaatgattcaaatcgattgttttgttttcttactattacttaccagcgtcgcggctctctgctacggagctggcaaaatcggatttaaaaatctatgggggttcgatgatgacaagtctaatagtaacgttatcaagtttatcgacggccggtatattaatcctaatcgaaaagcacaataaatggacagaaatacagaacttttacgagcagcggaatggaacgcgccagaaccaccagaagaaaaagaaccaattgaacctgaaaccgtagatgaaattgaagataacagatttaccgtgacaacagcggcagaagctgactgggcacttatgaagctcggtgagattgaacgactcgaagctcaaaatgaagagcttgctaacaataacataaaaccgtatcaagattggctagataagcagaacgcaaagacggccgatagtaagaattacttcaatcagttattaacagactacatctttgaagagaaggctaagaaccccaagtttaagttagtgacgcctaacggaaaattatcaacgcgtaagcttcaacctaagtgggaatacaacgacgacgatcttatcaagtcgcttaaatctaatgatgaaacagattttatcaagttgaaagaatcagtcgacaaagcaagcctcaaaaaggttgcaaaagtcaaagacggtaaagtttactcgccaaacggtgtagctcttgaaggcgtaacggttagcccagcaagtgaaacggcagttatcaaaacagcggaggttgaataaatgatggaagtaaaaaaggctaaacgtgaacagattaaagtcccaatcatgattactggcgctagtggttctggcaagacagtgagtgcgctactaatcgccaaaggaattgtagaaaagaagtttcctgatatgtcggcagaagagcaatgggaaaagattggacttatcgacacagaacataaacgtgcgttgctttatgcagatacaactgttgccaaaacggaaattggtgagttcttacacgttgatttcgaaccaccattcacagttaatcgctatattgaagcgtttgaagctttaaaagaagccagcgtagaagttgtcatcgttgattcactaactcatgcgtggagcggtgaaggaggtattttagagcaggttgaaacaatccaaaagggcaaccctaaaatgcaaatgatggcgtggaacagagttaagccattagaaaaacaattcttaaatctcgttactggtagctccgtttatatgattggtaccgctagaagtaaacaagcgtacgacatgaataaaactgacggtaagacccaagtcgttaagatggggcttaaacccgaccaaaaagacagcttagaatacgaatttgcaatttcaatcaggattgaccaagaccatattgcagaagcgactaaagacaactctaacttgttcggtacaccttttgaaatcacaccagaagttggccaaaagatttatgaatggtcaagtgaaggtattgacttagagaaggttaaaagagaaacgatccaaacaatcaacgacttaaaaagcttaacgcctgaacacgaaaaaatgtttacagaattacattcaaaagttaagtcggcacccctagaaacattacccattaagctgcttgaacgaatggttgatttattgggaaatattgaaatcaaagaagacgagcctaaaccagaagaagtatctgaggaaaatgatgggcaatgaatgatattcggcaagctcggtaagtactcaaaacacaaattagaaattgaaacagatgatgaactagacatctataagattagcaagtatgccaatgggcgtagcgtgtccgtcagcgttacgttatgccactctgcgttaatcatcatactgagcggcataataaaggcatcgattcatttatcaattattatcacatcaaaccggttaaaccggacttagatggctgaaatcaaatggattaaattgacggtaaacatgtttgacgatgaaaagattcgactgattcaggctatgccagaagctgacgctattatcgtgatttgggtcagactactgacgctagctggcaagacaaacaacgacggtcaaatttatgtcagtcagaatatgccatacaacgaagaaatgcttgcgactttgtttagcaagccgattaacacggttagacttgcgctcaatacattaaaaagttttgaaatgattgacgtgtttcaaggcgggacaatcctaataaacaactgggaaaagcaccaaaacatcgagggcatggaaaaggttcgagagctgaacagggttcgaaaacagaaacaacgtgaacggttaagacttggaaataaaagtcacgcgacgtcacgtgacagtcacgcaacagatatagaagaagatatagatatagataaagaaagagataaagagagtaaaccattgtcgggtaaccccgaccctattccctacgacgagataatcggctacttgaatcaagtgactgggaagacttttaaaaatgttgaatcacataagaaactgattagagctagatggaacgagaaggcaactctggacgactttaagaaggttatcgataacaagtctagcgagtggctaggaaccgacatggcgaagtatttacagcctagcacactgtttggaaacaagttcgatcagtatttaaaccaaactaatgcaattaaacagaaagggggctcttatggtggaattgaattctagatggtggaattgaattctagtattggcgccagctttaatctgctgaggaaagtaaaggcattgccagcatattgcgaaatacacacagattgccgtctggtgcaattagaagggcatgaacctttctgccccgagtgtgccaagaaaaacattgacgagcgtaataacaacgttgtgcttgaagggacgtggcgtaattatcggagagccttccacggcgtattgcagtgtgattctatctttgacgatttcgagttgaagaaggcaacttttgataattatgaaactacgccaaatactgaggcagctaataacttgctaaaagccagacagattgccggtaagtatttagaccgtgattataaggccaatacgattatcacaggcgttcctggtgtcggtaagtcacatctagccgtatcaatgctaaaagctgtcaatgagacgatacagcccgacgcttcatgcttgtttgtatcagttaatgaactaatgcgactgattaaagcctcatttgactccaaggggagcgaatttacagaagctagaatggttaagctactgggcggtgttaacttgctagtacttgacgatttaggaagcgaagcctcgtttcaatctagctcaagagaagcaagcgagtgggttcagcaagtcctgtttggtattttgaacaaacgcaatcgtacgatcattacaacgaatttaacaagcgaggaattagcaaagatatacaatcccaagctattgagccggatgtataaggggattgctaaacagaatggggtcatcaagtttacgaaggcgactccagataaaaggatggttattttctaaatgaagttaacaatcacgggtgaaccagtagcggctggccgtccaaggttcagtagtcgcggtggctttgttaaagcgtatgatcccaaaaagagtcgggattataaagttctgcttaaagagcaggctatgcaacagttgccagacgattatcaaccgatcggttgtccgattgaagtcgatataaatgtctaccggtcaatccaaaaatcggttagcaagaaagagtatgctagaaggctctcaaatgaggttagaccgacagttaaacctgatgtagataattacatcaaaatcatcttagacggcttaaatgggctcgtatggcttgatgataatcaaataacagacgtagcagcacacaaatattattcagatgaaccgagagtggaggttgaagtacatggatcataaatggatcataacgattttacagacgaacaacagttattctacgacaacttagataaatcagtgggattatctggcaacgactttgctacgggctacaaaacgttgctggacatcatttattatcgggtcaacaaagagttaagcaatgcgtttgaaacgatgtcagaagaagataaacgggctgtaatagcagattactgcttgccatattagatgattaacagagtaattctaataggtcggctaacaaaagacccagagcttaaatatacgtcgtcaggtgcagcggttggctcgtttaacttagctgttaaccgccagtttacaaatgccaatggtgaccgtgaagcggactttattaattgtgttatctggcgtaaatcagcggaaaactttgctaactttacgcacaaaggttcattggtggggattgacggccgtctccaaacgagaaattacgaaaacaaacaaggtcaacgcatttatgtgaccgaggtcgtagtagataactttagtttacttgaaaaaagagcgtccgataattcgaacacaaatcagacgcaagccggaagcaatcagacgcaaagcaagccaactgatccattcgaaggcaaaggacaagccgtcgatatttcagacgacgatttaccattctagatgacatacgtgttattaggcatggagacgcaatccgtgttatatgaagctgattatcggtcggaggttaaccagcaccgtttaaaggctaatccgagcgaacctatggcgattatcaataagcgtgatttagatagagccttgacgccgacgaccaccgatgatctaaaagataagtattatgtgcgcgattgtaccgtgaagcaacagggtgaaacacttgcacattatcatgaacggttaggcaagcagcttagacaactattcaataacggcatgaatcgccaagaatgcttaattgaaatgggcattagcaactcgacactaagcaacattcaacaccaacaaggcattaaattcaagagaaatacaaagcggatatcaccagaaatgcgacgtcaacgggttaaagatgtcaccgcctgtattgctagcggaaaaaccgtgattgaaacagcaaaaatcataggtatcgctgatagcaccatttatcagattgttaaggcacaaggactagaaatacaaggcagtagaagggatagagtggtgccggtcggattatcacgagatggcaaggtgcttaaattccagtcaatgacaaaagctgccaagtttctagcggttagcgttagtcaatttcaacattatcgcgatttcaacaaagatattaaaggttacagcattattgaattaacccctgaaccaattcattagatgactgaatgtaagtgttgcgatatcgttgaagttaaagagttaataaattgggttcataccaataagttgaatattagtgaaaccaaaattaaaccggcttatcacgcaatagaggtgcacaccgtgacaggaaatcacacggttggccgcgttcgtttggacaaggctaaaatgacattttttgaatatggctttaacgcgttaaccgcaaagcagcaaagtatactgagcgatttatttagaggaattatgttgtacgttcatgacaaagagtcagagggtgggaatgagcaatttgatttattacgaaatagatggagtaatgcaatttaaatgactgaatacgcagtttacaagggcgaccaatttatcgaccaaggaacagccgactatttatctgatagattaggcgttaaacgagcaacgatcatttggctacagtcgccgactaatcgtaaacgtgataaaggcaatcgaatggttgctgtgaaagtggattaattggaaacaataatagaaacgatcggttacatgatgattagctttatggcttgttgcgtattatcgagcgtcatcataggttttggtgtcgttgtgacagtgatcgcaaccggggttaatatacctcattttatcgataatttaagaatggcgattgctatgggactagggttttcaggattctttggatttatgctcggaatctctatgaaagttatggatattgaggaggattaaatgattaaaacctacagaaaaacagcaacaatccaagctgaacagtttgatgggtcagttaggatgattagaaaatatagcattggagtccctcgtggtgcctatgttgaagaatggccaatgaacacacttatgactctagaaggcccaatggaattaaatattggtgactggattgtaacaggtgttaaaggcgagcattgggcgattgctgacgatgtatttaagactagttatgtggaggctgactaaatggacaactacgagcagctcaaagctgataacaagaggcttaaaaagcgaaatgaatggttagagcaagccaactgcgatttaaataaagaaatagaagcagcttacgaaagaatccaccagcttacaattaagattgaagagatgttttagatgtataagatggacgagctattcccacaagtagacgagaaggcaacagttaacaaagttaaacactttctaaaacacgcactcccccaaatgcaaagatacagtcacaaagacatcagtgatattaagtcgcctattatcacagacatgcctaaaggtggttcagttggcaaccaagcagaagaaacgattacacagcgcgtttatgctgagcaagttatcgataacgtagtggtggcattaaagagttgtgacgcgatcagccgcaagctgttaatcgatgtttatgtgggcaagagcaagatgcctgattacctagaaatggaatccttgggttatgagaagacacggtatcagttttataagaatcgggcgtgtttacagtttgccgattcgtttatgatcgcggacttgcatattttcaaaaagtgaatggaaaagggcaaaagagaagtaactggtagtcaaaacatatctttcagagtttctggagatgaaatgacacatgacagaggttaccaattagactatgtattgagttctcttgaaaatgttcaagacttaatcacaaaaacatatttagctttaaacgaacgccaacgttttacagaaagcgatggagaaaaattaattgtgagactaaaggaagtccaagaaggctcattatggacgttgcttcaagtggattacaactctttaatcgttccagcaacagcgtttattgcagctaatcccgactttgtgttatcaactataaaagattcttatagttttttgaaagctaaatttaaagctgagaaagaaggtaaagcggtgcatgttgaacaaaaagccgaagctggaagcatggcgatacacgacagttttaacggtgataatcaaacaataaatattgttataccggcaggaatggataaagtagctgagcagttacaacctcaattcagtaaaatgactgaaaacattgatgggaaaaaagtaaaatcgattagtattggggactctttatcttcatcaggtagcgatgaaccaataaaatttgacataaatgataaagaagtattttcaggaaaaacatttttatcagaagacgaattccaaatcttaggcaaaataacttctggtaacttcgaaacaaatagagggagaatagaaatagtgcaaagcgattcggatgaactaattataggtcgcgtttacactgcagtcattgatgaagaattgcatgcggaagaagtgtggaaacaaatgtttttaacaaaacgcccgtattattgtaaatgtcgatacaacaaggcatctaatggccaattgaaagtaaaggaagttattattactgattgggataacgaaagatgggaagtagcataattgtattatatgaatcaaggtagctacaagaaagagcctgattggcaatctaaagccgatgcaaggttagagaagtggcttaaggataagaaggaacgggaacgacttaagcgcgttatggataagcggatagccgaaaataaataaatggttgacaaaagtgtacagaatgagactttttatgaattggataaagcgaagcaaacagctattgtattgctgtttgaagataagttgagcgatgaacagattgctaagactgtaaaccgatctaggacaacgttatctaattggaaaaaggacaacaagtttaagcaagcacagatagaatatagacgcgttgcgattgatagttatgtaccagatgcaattaaaaggcttcataaattagctacaggtgctaagtcagaaatggttagccttcaagcagcccagagtatattatccatggcgggcttcggttctgttgacagctcaccagaattagaacaagcaaagatagaaaaagctaaagccgatgtacgtaagattgaagctgaggctgatattaaggaagctgaggctaaagctgttggggatacggatagtagcggtattaccttagaaatcatcagaacggatagacgggggcaatcagatgaaactaagagttaaatgaaactaagagttaacttagatcagatgattagtcctcattttgattatgttctttattcatcagcacttaacaaagtgttaaaaggcggtcgtggttcaaccaagtcatcggttatcagcttacaaatagtgctcgacttcttacaagatgaaaatgcgaatgcattaattataaggaaagtcgctaatacaattgagctttctgtttacgaacaaatcaaatgggctatttatatgataggtgtacagagtcagttcgcttttactaaatcaccgtatcgaataacacataagcctacgggtacatcgttttattttagcgggttagatgaccccgcaaaacttaaatcaatgatcattgctaaaggctacatttgtcagctgtggtttgaagaattagctgagtttagcagttgggaagaagtcgacactgttagagcttcgtttacgcgtaaggtgctgccaccgggcaaacacgttgttacttactattcttataacccacctaagaatccttatgactggataaacgagtgggtaagccaaaagatgggaaaagataagtggtatgttgaccattcaacgtatcaagacgtcaccttgccagacattctagcggaggattacttagatgaaatcgaaactgttaagcagaatgattacaattactatcaatggatgtacaaaggcaaagtaattggattaggtaactcaatctataacatggatcttttttatgaaattaaccaacttccggataatgattacattgctcaacttgcttattcaatcgacgtcgggcatcaaacaagcgccacaacttgtctatgtattggattaacagggaagaacaacgttattttgctagatacttattactactcaccagcaggacaaactaaaaagaagtctccgggcgaactcgctagagacattcatgactttattgctgattcagctagtgcgtacccaaatgcgccgattgtaaaaagaactattgattcggcagaaggcggtcttagaaatcaatattacagtgattatgggacgcgcctacatggtgttaacaaggccatgcgtaaagaaacaatgattgattacccgcaagaattgctagcgcaagggcgggtttttattttgcgcaaaaagacaaacgaaattttcattacacagcaccaacagtatcgatgggacgaaaaaacaatcgcaactagcgaccctaaagttattaaagaaaacgatcatacttgcgatgcgttccagtatttctgcattgacaacaagcggctcttaggactcaaaaagtagatgttcgaaaaaatcaaaaatctattcagaaaggcaggtgtagagctaggtatggttaatagtttaactaagattgtagaccacccaaaaatcaacgttgagcagtcagaatatgacagaattgctaaatcattgcagtatttcgagggcaagttcgacgatgtgaagtatcacaacagcgaccacgagctaaaagaacggccttacatgtcaattaacatgatgaaggtcgttgctaagcgtatggcatcgttgctttataacgaacagtgtcggattattgttggcaatgacgaaaagttcaaagatgctaatgagtttattcagcaaacatttagcgaaaacgacttcaacaagaactttgagcgctatttagagtcagatttggcgttaggcggattagttatccgaccttacttcgatgttggtcaaggcaagattaaattgtcatggtgtcaagcaccgactatttacccattacggaataatacaaatgacgtatctgaaatcgcgattgcttcagttaatcagactatcgaaaatgacaaggttgtctattacacactgttagagttccacgaatgggttaatggtgcttatcagattactaacgagctttatcgttctgaaaacaagtcggttgtaggtattcaagtgccgttgtctagctatgaagcttataaggacattgcaccagtagctatattaaatgaggttacacgaccagtatttatctatctaaagccacaaggatttaataaccgaaacattactagtcctttaggcattggtgtttgtgacaacgcattatctaccttgaagcagattaatgataccttcgaccaatttaactgggagattaagatggggcaacgtcgcgtggctgtgcctgaagatttaaccagcttagcaatcgatgagcgtggcaagagtcaacctaagcaggtatttgattccaatcaaaacgtattcgtaaaaatgcgtggcgattctgaagaaggattcaaaatcactgatatgactagtgagattcggtcacaggattacattgaagctcttaacaatgcgttacaggtgttagaaatgcaagttggtttaacggctggcacgttctcattcgatgctaaaggcggtttgaagacagctaccgaagtcgtgagtgaaaacagcatgacccaacagactcgcagcagccaattaactacggttgatcgtgcaattaaagagttgattatcagtattcttgaactcgctaaggcttatgaagcttacaacggtgacattccaacgatgggcgacatttcaattgattttgatgacggagttgttactgacaagcaacaacagctagacttctttactcaagctaagtcagctggttttgcgtcaaccaaactagcaatcaagaaagtgtttggttacaccgacgaccaagcggacgatttaatcaaggagattaatgcagaggtgccgaatgaaccagccgtgacaaacgtccctagttttgaagatggtgatgagtgaatgcaacagctagacatctattctagtcagattcaacgtgtttatttagctttagaagatgaaatcattaagatgctgattaagcggctcaacactaaaggtttagatggcgacaatttcaatgtttatagctggcatttagaccgactgaaccaattaggtgcgttgaatggggaaaccgctaagttagtttctaaagcgactaagattagcaagcccctcattgaaaagatgattaaagattcaggctacgacattgcagaagcgacttctacaaccttgagcaagggtttaagcgttaataaaaagcctgttagttctaacgtggatatgattctacgcaatatgctaaaacagacgttcctagatttagacaactacgtcaatcagacacttatcacgactaatgcaggtcaaggagtcgtttctaaggtatatcagtccatcttagagaatatggtggctaatgttaccacaggaacgacaacggctaaacaggcgcttaataaggctatgtatgagctagtcgataagggtttgaagtctggcttaatcgacaaaggtggccatcattggagtgttgaagcttatacacgcaccgttatggagtcaaccacttatcgggtcatgaatggaaccagaatggaacaagcccatgagtatgatgtccacacatttgtcatgagcagtcacccggctagtcgtgcagcatgtgcaccaattcaaggcaaagttgttaatgatgtgcttagtgacagtcctaagtacgataagcgttatccgtcaatctatgaccatgggtatggagaaccagctggttgttttggcattaattgccaccacatgaagtacccgtttattccggatattaatactaatcatcaaacgcaatatgatccgattgaagcgcaagaaaatggcaaagctcaacaaaaacagcgccaacttgaacgcgcaatccgtaacagcaagcgtaagttggatactgctaacgaattgggcgaccgagaaggcgctgagagatttaaattattaatcagaaagcaacaaggggctttacgtcagtttattggcgataatgagtttctgcatcgtgattattcaagagagaaggttgtttaaatggctgaaaaaacaaaagttgggatacaaaaagttgaattcattggtgaagttggcgacttaatgcaagttaatcttaaattgaacatcggcgccatatcgtcatcgcaaaatattggaatgttagaagaattagtaaacaagattcaagtaattgaattaggtgaataaatgaaacgtgaggaattaaaggcactagggttggaagattcagcaattgataaggttatggccttgcacggtcaaacagttaacggattgaatgctcaaattaatactttgaacaccgaaaaggaaactttgaccgaacaagtcagccaatcagccaagcaattagaagatttaagcaaggacaacgcggataacaccgagttacaagctcaaattaaacagttgcaagacgataaagctcaattggaatctgacagccaaactaagttggcagaagtacaaacgaattatgcaattgaatcagccttaaaagacgcgggcgctcgcgacgtcaaagctgtattgccatttattgacaaggatacaatcaagttggcggacggcaaggtaacaggcttagatgaacaattaaaggctgttcaaacggataaggactttttatttcaaccggcagaaccagaaccaagtaaactggcgattgttacaggggctaacgctaaccctagccacaatacgacagacgatccattcgctgctaaagtagcgcaatacgaataaatggcaggagaaaataataatcaagcagtacgttcatatcaaccgcaatttaaggaattacttcaagcggtgttccataaacaagcttatttcggagaattctttggtgggcaattacaagcattagatgggattacacataaccaaaaagctttctcggttaaaacgagcgatatccctgtggtagttgggacagaatatattaaaaataaagatgtggctttcgggacagggacagctaagtcaagccgttttggcgaacgtactgaagtaatttatagcgacacagatgtcaactacacatgggaatgggtgttacatgaagggattgaccgccacactgttaatgctgattttaatggcgcagttgccgaccgattagacttacaagcgcaagctaaggttcaaatgttcgataatcatggtggccaatttatttctagcgtagcagctgaaacaaaaccgcttactggcttaaaaccggataacgttactaagttatttaatgatttagcgacagcttatgtcaatatggagtccgttggacaaaaaatggcgtgggttaacccagcactttacaatgctttagttgaccacccattaacgactacttctaaatcatcaaccgcaaacattgatgaaaatggtatcttgaatttcaaaggttttagaatcaaagaagtgccagaagccaaattccaaactgatgaagttgcatatacatcaattgtcggtgtcggacgccaatttactggcattgacacagctcgaacaattgaagccgtagatttcgatggtgttgctttgcaaggtgctggtaaggctggcgaatttattttaccagctaacaagaaagctgttatcaaagtaacgatgagcgcagcgtcaaaataaatgacagcagaagaccgctctaatcagacacttaaaatttatgacaaaaccggaaaactaattgttaccggtgaaaaaggcaaaggtactgcgactattactggcttagcagctgggactaaagttgcaactggtgactataaagcttcatttagcgacggaacgaacgaatcggataaagtggacgttccagtatttaacgtattgccagcagaagggtagatgctgacttatgacgagttcaagaaaatggggttcaaacttgatgaaaccaaattcaatgagctactcccgtttgcagagatccaattaaacattaaagtgcggcgttactacgagttttacgatttggaaagcgacttggagttcaggaagaaagcttacaagcgtgcaattgctttccagattctttacatggacaaacaaggcgtttcaacagctgatgatgtggccagcaagccgacttctgtatcgcaatctatcgggggtacaagcgtttctaagtcgttcatgtctaatagttcgagcggtggttcaaataacgcagaaacaagcgctattagtttagaagcacttaaccagctaagcggcactggcttgttaattcgaggtatctactatgactgaatgactgaagtaatcgatgcgagttggctggttgattctattacaattgccaaggctattgaagatgattggcaaaataccacttatccagacccgattacgcttgacaacgtgcgtgtcgacttaacaaaacaatataccggtacaggaaataatcgtgagatcgtagctaatgcaacggtctttttgtttgcccgatttactggtaattattttgtccccgatgatgattggcttaaatctaaggtggtttacaatggtcgtgagtatttagttaccgattacgttataaatcacgaggtcgagaccaataaaccttacagtgtcgaattgaaggtgatttaggtgggcgatattaaggtgaaggttgatttgagcggtgtcaccaagaagttatcagctgccaatttcaaacttgggcaattcgcactagccaatcaggttatggccgattcaaataagtttgtcccgagacgtgaaggagatttgcgaaattcagctcatgttgattctggtgggcaatttgttgtttgggaaatgccttatgctggccgtcagtactatggtgttggcattcataactacacaacgcctggcactgggccgcgttgggatttaaaagctaaaggcatgtacctaaattcatgggtagacgcgtttaagaaaggggctaagctgtaaatggactttatggaacggctgaaagataacattaatagtctgtctgatttgccaatgaagttaacgcttggttatttaacggctaaggacagtttggttctttacgcgttgccaggtggacaagttatccgtgagtattacgacggcgttaaagaccaatcgttgaactatgagattggcatcaaaactaaagaccagcagaaggccaatgcgaccttatggcagattcaaacgcaccttgaacaggttgaagaattaattagtaacgattcaagtttccaatttcaaaaattaagcgtaagcaacaagccttttttgtcggaccaagacgaacagggtttttttatttacctgcttgatgttcaggcagatttaacaacatttaaaaaatagatgcgtcaaaaaaatgcaaagcgtcggcactttgtcgcaccttggacaagtgatgataagaaaccagaagaagaagattacttaccactagcaaaatggattcccacaatcgaagatgattcagatgaagacactgacgattatggcgattatgcaggtgatggtgcaaaccgaacaatccttaatggtcgttctgaaaagtggaactttgaaggcacttatgatccagaagataaagcccaaaagcttatcgccgatatgaagcgggttactaccgacgatggccggaaattatggcacaagattatcgaaacgaacgggacaacggttgaaggcgttgcggctgcgatggaaatcaaggccggttcaggcgatgccacagactatgaagaattctcaggccatttagattatgtccggacacctgaagtgactccgtcaaaataaatggtattgaaatttcaacaagaagtcgatggcattccgctagaagtggcggtcaaacaattggatggtacaaataagattgtctctttatttatttcaacggatgcggaatcaattgccgatttgatggacaaagcagattcaatcaaggctaaagcagaagaattgaaggttaaatatcccgctttaaataagcaaattgatgatgaagatgttgaaggattccgagaagtcattaagggcgccacagagctagtcaaagctaattacgatgaattgttcggcgaagggacatatgatgagttatcagaagctggtttaggtttgttgaagctaatcccattgttaactgatttaacggacggagttaccgaagaattagaaagcaaagttgccgaaaatcaaaagaaatctgataagcgtaaggctgacttgttaatcaaaaataaaaagaaacaaaaatagatgttcaaattgaacgaccctctaaacgattatgtaacgattaacgatgaagagcacccaatttatatggcgtttgataacgtcatgagcgccttagagacgttcgacgataaggaattgagtgagtctgatcggttgtatatcttccttggtgtcatgctccacgattacgaccaagagctaattagtgcccttgatttcgagacacaagtagatgtgggtaagcagataattgaccagattaacagtgagccaatcgaaaaccaaccagttgaccttgagggcaatccaatgcctcaacccaaaagagatggcgaacagctagtctcttttttgtttgatgccaaatacatctatgcagcgtttatgcaagcctatggcatcgatttaatcgagcagcaaggttcgcttcattggtcgaagttttcggcgctactcaatgcgttacctgataacacgctaatgcgacagattatcgatattcgtaaaactgacttgaacgaaatcaaggacaaagacgaaaagaagcggattaaaaagctcaaacaacaattcagcttagagggtaaaggtagccctgatgaggaaggaggggatatgtatggctgaatggctgaggggacagttaaaattgcgattgaagctgacggcaacaaggctattaagtcggctaaagatttagagaacgtttttaaccagcttggaaatggcaatggcaccgataagttatcgaatgggttagatgaggtatcaggtcactctgactcggctaaaatcagcataatgagcattgtaactgccttagggctcgttaaactggcgagtgccgcgtttaacgcggtaaaaaacaatatcggcacagtaattagtgaaggtaccaagctacaacaatcgcttggcggtgttgagacgttgttcaagagttcggcaggtaaggttaaaaaatatgcgaatgatgcttttaaaactgctggtttgtctgctaacgattacatggaaaatgtaactagtttttcagctagtttaatttcttctatgggtggagatactgcaaaagcggcagacgttgcaaacatggcgatgatcgatatgtctgataatgccaacaagatggggactagcattggggatattcaaaatgcttaccaaggatttgctaagcaaaactacactatgttagataacttgaagcttgggtacggtggtactcaggaagaaatgcaacgtttattggccgatgccacgaaaataactggtgtcaaatatgatattaataatttatcagatgtatataacgctatccacgctattcaaaaaaatcttgatattacgggcacaactgctaaagaagcggcaagtacctttagtggttcttttgattctatggtagctgccgctaaaaacgtggcgggccgaattgcacttggtatgaatgttgataagcagctgcagcagttagctgatacaatggcaacgtttattttcggcaattttatcccgatgataactaacatctttaaagcgttgcccggagcgatgaaaaagttcgttgaggcggcaatacctgaaataacaaaaggaaataaaaagctagcagatagtgttggcaaagcttttaaaccagcgattgatgttattagcgatcttgcaagtgcgtttaaaaagataatccctgtcattgcaccatttgcgaaagatttgggtattgcttttggcgtcgtttttggtggaattgcggttatcaatagctttaaaaaagcgttaaatggtattggaacagcattcggggctatcgtgagccacccgatcatttctattttagttattctgattgcatcgcttctctacgcttatcaaaactctgaaaagtttagagatggcgtcaatggggtggtaaaagcgataggcggttttgcaaaaaaagctgtcgaattcataaagagtttaaacgattcaaaagactcgtccgataagctaaaaaatgcttttaaaatattagctggcaccaccggggcacttggtttattagtagtcttgaaaaaaatagtaggggcaattaaaccgctcattagtgcatttaaaaacaccaaaaatccggcaaaagcattaggagatacaatcggtggctctggcacctctgctaaaaaagcttccggattctttggtgggttcggtggcaacgttcttaaagccggagttgggattggcatagcagccgccggtattgctcttctagctaaagccatgcaagggattgcggagactggaccgagcggagttggcccgattattgcatttggcgcggcggtatctatcatggcaggaaccttggcgttggctggtaagcagcttacaaataatgctgtgggcattgtagtattctcagcggcagtatcaatcctggcgttagcgatgaccccaatagcacaaactgggacagccggtgccatcgctattggcgctttcggattagcggtaagcggaatggcattagttttaggattggtcggcccgttactcacagctaatgcagttggcatcgctgtattcggtgcctctattctggcaattggtgctggggtttccttagcaacacttggtattgctgccatgattaattccgtagcaaatctaacgcttgcgtttattgcattagtagcagtacgaggacaaattgtcgagacgctaactgctattggtgttgggctagcggcaatgataaacggtttcattaatactattgttgccaatatgccaatagtagttaatatgtttatcaatggtttactttcaatattgcaaaatatccagcaaaaaatgcctgagtttgtttcggccggtgcagggatagttatttcgttcttgaacgggattgctagaaaagtgccatcgatgattggtgcggcagttagcattattgttgccttcattaacgggattgctcagaatttgggccgtgttgttaacgcagcaatgaatttagttgacgcaatggtaagaggtatattgcaagctcaaaacagattgttaaccgctgctacgactttaattaatgggtttgccgataacattagaagtcacaaagatgcaattcgcggcgctgccctcaacctgctagatgcgatgattcgagttttcgttccggattctttagtcgatgctggtgaagcaatcattaatggatttttaggcggcttaaagcgcggatttgaaaaggtaaaaggattcgttggcggtattgcaacgtggattaaggatcacaaaggcccaatcagctatgataaaaagctcttaattccagctggtaatgccatcatgaatggtttaaatagcggtttggttgacaagttcggcaaagttaaacaatcaattgccacattgacatcaagcattgccaattcagcagtgattacgatgccagcaattgaagattcagcatttaataagtcgttaaaacggattaataacacacttaataacaaccaattatctgcgggccttagctttgctggcatcacagcggagagtgcttcaggcattggacgtggcgtagcaccaactaactcagttgttaacaattacagcaatactgcaacgacaacggttcagacagctaaagagtcgaacaacaaggtgctagaggcgttgaataagattgctaataatagaccagttgcagttgtagacgggtcaagtttcgcgccagcttatgagccatatggatcaacagaaacggctcgtcgtagccaaatgaaaggtaggggattggcagttgacagcaaattctaattgacagcaaattctaaatacgggattgaattcaatggattacgatcggacagcttgggtttgacggtcatcaacccaaaagaaatcggcttcccgtcaaaaaataagattgtccaagacctgcctttcagcaatacgattctggatttgtctgaaatgtatggcggccaaagctatagcgagcgcaaactcaagtttacgtttctaatcgttgaaagtgaccgtttcgacaagaacgcgctttatacccagtggacaaagacggtcaactggcttatgggcgctaatcacaaagttaagttaaaagatgatgtcatgagtgagtattattacttaggcgaggttcaagaggcgccgtcatgggacgagtacgtccggcatggtaagtttacggtcgagttcatctgttatccattccggatccacgaattggccgaaggcaatgacatttgggacacgtttaatttcgaattagacatcgctcaaattaccgaatacacagtcgtaggcagtcgaacggtaacgctctataacattgggcagaaccaagttaacccacagattgtggcaagtacgccgttcgagattacagctaatggccaaaagtatgcaatcccagccggtacgattgaaagccctgatttcgtctttaatcaaggcgaaacaaccatgacaattaagggtaatggcaagataagttttaattggcataaggagttgatttaaatgtatcgcgtaacagtacgccaaggttgggacgggcaagaaacgactattcattctgaaaatatgagtagcgtcaaattgctatctgccaagataactaaagatgttgattcgattgattctttcgccttcaatatcagtcctaaatcgtcacagtacaatgcttttaaataccgaacaacattcgttaaggttactaatacgaagcttggaaaggtgctttttgaggggcgtgtattgccaacgaccgattcgatggatagtagtggtatctttgataaatcggtcacctgtgaaggtttaacggctttcttgcatgattccattcaagactattacgcactgtctaacaacgatttaaagacgtttctaagccatatgattgacgtccataataggcaagttgattcatataagcgtatgaagttaggcaaagtgaccgtaacaagcccgtctgacaacgtctataagtccattgatgattcaaagacgacttacgacacaatcaaagagaagttaatcgataagtatggtggtgagattcgcgtaaggcatgaatctgatgggctttatcttgactacatgccagagattgcgacacttagcagccaagacattcgattggcaagtaacctgctatctttgaagcgggctattgatccaagcgaagcttactcggtcattaaacctttgggggctagagctgaaacaacgactcaagccgaagaaggtgagtctgatatttcacaacctagattaacgattgagactgtcaataacggcagcctttttttatcgtcccaatcgatgattcataaaattggctatgttgtccatgctgaagtgtgggacgacgtgaaagtaccatctattctcaagtctaaggggcaagcaatgttggatagtcagcgagaaattaaggagcagtttcaagtaacggctgttgatttgagcctgttatccggcatgacagtcgacagttttgaatgcggcaattaccaccaaacgattaatccactaatgggaattgatgaacggttacggatagtcggacagtcattggacttatgcgaaccgctcaattcgacgttatcaatcggggataagttattgggccaagctgactacgaagcgcttatcaaaaagcaaggcgaagcgattgacgaaattaaaggaagagtggctgcgcaaaccgctagaattgttacgattacgaaagaaatggagtcgaccaacgaagccttgtcatcggcgcaaaaagaattatcaagcctcaaaaccgaatacgacaagttaattgaagatattggtaacaaggatttcaaagcaattatgtccaaattgacggaactagagaatcgaacgactacaatcattaccaacctcggtgagattggtcaaaacgtgcttgatttagagacatttaaagcaaatcaagaaacaattaatgctaatcagttaatgactaacaatcagcagaaaataaaaaatgaagattttgaaaagcgcatcttagcgttagaaggaggtaataaataggtggcagatgaaatcaaaagagatacagtagaatatcgtgatccaacgccgttcgacggtagtaagttaaattctgtgagcgatattactcaagctattcgtcataagttatatggcaaagatacacgtgaagccatggcacagtcacttgaagctttagtacagcttatgcagaaagcaggtggcaaccaatccgcggaggtcattgcggcgcgtggtaatcacgaattattatcaatgcgtgaagatgcacaggataatgcgatcgctacggtacaatcaacggcaaatggtaaatttgacactaatcaagcagaaacatatttgaaatcaattacagcacttccagagacttttgctaatttagcggcgattaaagctaaatacccaagcggcaaaaatgggttgatggtagcggctgataatggtcataaatatatctgggctaatagtacatggacagacgctggtgtttatcaatctgtagggattgctgatggttctgttacgcctaataaaattgcgcctgggtcatcagtaggattagtttttgcagaggatgattttccaaactttaatctggttgataacacgttcgaacttaatgggagtgtcaatgttgtctaccaaggtagtatctataaaaaatatggtggtatgctgccattgaagttatcaattggacaacgcggttttttatgttttaatccagccgatgggacaatcgtttatagtgaatggtatcttgatgatagtctagttgtgattggtgggagattaaacggctactgttttctcaatggacaatatactgtcaacgggaaagatccaagtaatccaataaaaaatactgcgccagagtataatttgtttgctgcaagaggcgggattgtttgggatactgataagcgattgttaacatgtaaatctactgtgattaatattggaagttatactaacgagattgatggcacgccagttagttattccaattattcgactcaatacatttattttaatcctcaaaccaaggccattgaaatggcggaaccgccattaaatgttaatggtaataggcttgcaattggctggttaagccacgatcgcgggttaattcacttaaacgtacccagcgaatccattaaagtgatcccagatcagccaaaatcagaaggttatttaacgcaaatgacagatgtgattgctctcggcgattcaataacatacgggctacacgcaacggaccccactaccggaagttggcccgcaatcatcgctgcaaatactggcgttaaaacctataatgaaggtgttagctccgctacgtggcagaatggagggaataacgatacgatttcgttcgtaaatcgctcaaaaacaatcgattggacacgtgctaatgctatagtgctatttggtggaacgaatgactttgcgcagaatctaccaattggaacgttggatgatactggcactaatacaatgttaggcgcaattaacaacgtaattaaaactatttattcaaaaaatgacaaagccaacatttatctagtaacgccgatgtggcgctcacgaatcaacgctgacgcagttgacgttgagacgacgccgaatgattctgggctatatttacgcgaatacgtggacgcaattaaaaaagctggcgataaataccacctgccgacgctagatttatatcgaaaatttaatattaataatttgaatgaacagacgtggctagcggatggcttgcatccaaatgatgccggttatcaaaaactggcagaaaaaatcgctaaatttttatcgaacaattaattgagtaatgataaggatgatttaaacgtaacagagatgctaattgacattcgggagcgcttagcccgcgtcgaagaaaacactagcaatcttgattcaacggctattaaagctagcaaggcttattcgatggctaaagagaaccaaaaggatattacagatttaaacgagaggtctaaatggactcaacggacagctattacagccatcttgattccaattggtctttttttatttgaaaaattaataggagggtaaatgattaaaaaagtagattggcattcaaaagtgttgtggacgtcgatgacggcgttagtcatcgtattagttcagcaagtggccaaggttttcgggattgaattcagcaacgacttagctagccaagtacaaggcattgttaatacggtgcttacaatcttgggcttaattggtgttatctatgacacaacgaaaggagattcaaaatggaaaaattaaatggaaaaattaaataaactagtagtcgcctttggggcggctattttattggccgtgaattttacaggggtagcgcaggcttcttattcgattgactacacgtatgcatttaatgccaaccaaggcagctcacaacgtgcttcccattcatttgtaattttgcacgaagccggacttgaagcgccggggagaaacattgcggctaacatgaaaaataactatacaccttacacagcttactcaacgtttgtggtcggggatggtggacatgtctatcaagttggggcgccgggctatgttgcatatgcagcaggtgacgctaatggttacagccccgtccaaattgaactccaacggacgtacgacaaggccacgttcgcgaaaaactatgcaacctacatcgagttggcccgagattacgccaagaaatacggcattcctttgactcttgatgctggcggtgctggtacaccgggcattaagtctcatttatggattacacaaaatatctggggtgaccatgttgacccttatggttatctagcatcaatgggcgtatctaaagctaagttggcgaatgatttagctaacgggacaactaacgttggtggcgggaataccaccccaaccaatcccacaaagccaacgacgccaagcaactcaaacgtgcctgctgggtttactcctgaaaatggcacgtttgtgaacggtgatactgaaatcatgaaccgcatcggtgcagcaagcttcacagctcaaaaaggtggttacttgccagctttcggaacatggaagtacgactcatggaaacgcgttggcaattatgtgatgatccaccacgtttataatggtgtgcatgtattcctgccagtgcgttataattcgacggcctgggggacatttaaataaatggaagaaaaagaaatgaatatactagggatcttgggttttgtactctctgtattttcactattcattgccgtaaagactacgttaggttatcctgtatggattattggaatggtgttttcagttgtgggattatctaaagaacggaagggatttgcagtagcaggagtaatcatttcctttatatctctgattgcattttttgttttagtgacatttttattagttaatttacctaaaatctaattatagtgagttaggcttattttttttcgttttaaaaatttgccaacaaatatatcctgctattactaggagactcgaaattattataaaagtaattatgcttttattgagcgggacataatatattaaacatcctattgaaaatataaaactaaaaccgctgatggcaaacatgaacaagggataacgatcaaaaaaattatgcgagcaatcagtcgtctttagacatccacatgccaagtaatgtttattagagatgataccaatggcttgtaataataaaaaaactaagattgttagtccgcacattaaaagagaagaaaacattaaaacttttccgacggacacatcttttaaattagataacatttctttaaatgcatcaaagccaccaaaaacgccaaatactaatgctgaaaaaatacccaatattgctataaattctgaatagattgatgattttgtggttttaatattctcaagttcctcgtgaactccggccgtttcatttttaagagtattaacgttctgtaggataaaatctctttgaactattgataaatttattttgtctataaatttatttatatacatattttcatcattggatacgtcctctgataaacgttcaacacttttttgtaaagcaaaaatttgattatcattatagccatatatttcttttgctattaatgagttactaagtacaacgttattttgttcgcaaaaagaaagtatgtctagggcttttttttgtatatttgatttataatactctgtaaatgcagagacatttgtaacatcaacggaatctgacgtctcagaaaagaacgagattagtctaacgtaaaaaattttagagtctgtcatttaagactcctttagaaagggaatatcattgtttttaaagtaatcctttatttcatcgtttttatatttaggagcaatttgatgtgcaatttgatgttcgtatttactccataaaagttcttcgtgtgttttatcgacaagatcaaaagcattgatatgaccgagatgttcaacgattaactgtatagaatttttttcgtcatcacttatattatcgggttctttccacttagttatttcaaagctttcagggttgaacttgggagcgggacccgtgataacatcagatccattacttttaaaagtatcatatacggttctctcaacaggcccgtatgaccaccgttcaaatgtgccatcgatcaacggtgtatcaaaagtttttaaagaataggcattcgcataatatagcaatttttgcagttttagatttgtaatcttaaggttattttcttgtgcaacttgaataataagatttgcagcgtctatagatctcatatgatttttttaaaagggatgctaattgggtttgcgtttgtcgcaccaattgggatgcaaaatattttcgtatttaataatgcattgtcaaatacgacacggcgcgcggttttaaatagtttgtttatttggttatttgatgcgctcttttccgtggtggccttttatggcattggtgcgttgattattcaaaatgagattattaagtatacgattatgggtgtcggcgggctgttgattttgtggattggctatacaattttacggagcgcgcgggcggccgtcgaatttggtaaattacagccaattccgctcaaaaaagtaattttaacagccttcattgccgtttggggtaatccgcaagccttgattgatggcacgttgatgctgggggccttacggggcgatatgactgccagtcaatcattaccatttattatcggcgttgtgacggcgactgctagttggttcttcggcattgccattttgtttagtatttttagagataaggtctcacctaaattcctaatgtgggttaacatccttagcgcattaatcattatcggttatggtttgatgttaattgtgaaagtggtaggtattttaatttagatggctgaattgttaaaagatatttatacagaagcattcctgacgacctttagtcagcaagttcaagaagtttatcggccctttaaagcgcaacaatttgtgagggccgttctagctgataattgggccgatttaacgttgaaacaacggacacgtcagattgcaatcgtactcggtcaattcttaccacaggactattcagaagcgattgcacttttagaacaactggcacctgattgtcagggctttgcctatctttttttcccggatttcgttgttgtttatggcacacgttccgatgattgggcgctttcaatgcacgcacttgagatttttacccaacaatcttcagcggagttcgccattcggacttttattttaacggatccaaaacgcgcaatgggccaaatgacacaatgggcgcaaagcgctaatgcccatgtgcggcgtttagcaagtgaaggctgtcgaccacgtttaccttggggagaatctttaccggtatttaaacaagatccgacaccggtcttagcgattctagaacgacttaaaaatgatcctgaactatacgttcgacgcagcgtcgcgaataatttaaacgatattgttaaggaccacccacaattggtgattgaaacggctaaaaagtggcagggacaatccgaagcggttgattgggtgattcgtcatggttgccggacgttattgcgaaaggatttcttggcggttcaaaccttatttggttatgcagccgatagtccagcaaagccgttagtgctagcagcaactatcaaaacaaccgcgacaactgtagccattggtgataaattagcgtttcactatcagattcgctttagaccggaagccaagctactggttcgggttgaatacgcagtagattatgtgaaggccaatggtcaacagtcgcgtaagttatttaagctagcggaaaaagaaattgatggtcgccaggggctacgtggtgaacggcaaattaattttaaagatttaacgactcggaaacactatccagggcaacataacgtggcactgattgtcaacggacgagaagtggctaaaactgcgtttgaagtggtccggcgtgaggagtgaatggctgaaaagttattgacgatttcggcatttgccaaattatttaagacaacgcagtacactattcggcattatgaggataaggggttgttattgccagcgaaaatcgctgagaatggctatcggcaatatggtatggccgaggcctatcaattatcgtttattctatttttgcgggcattagatttatcagtagctgaaataaagttgattttaacaacggattatccagaacaaacgatgcttctgaataaaaaacaagcgctgcaacaagaaattgcacggttacaagcgttagagcgaaccgttgatgagcaattacaacaagcgactcatgaaacaacctatcgagtcaatcaaacaattcacttgcgcgttttaaaacggctaccatttgcgcaagattttgacttatcggtagttgaagcaattgattggcagcctgatttgatggtccgccagctgtattatgtgattggcgaaacggattatgcgatttgtatcgcaacgcccacgccaagcgactaccacattgccgccggttgttatgatttcacgacaattgaagccgcgagcggcgcggaatttgatagcgccttgtcagccatcacgactcaccaaaacttaccgttaatcggcattgaaacgcggggcacttttttgagccctggcaaacacttagcggttaaaatactaggaaaaaggcaggtacaataaatgcaacttgaaacacaacgcttaatcctcagaccatttgaattgacggatgatcaagcaatctatgaatatgcaaaggatccagcgattggccccatcgccggttggccagtgcacactagcgtcgctaatagtcgcgaactcattcaaaactatttaatggcagaaggaatctattcagttaatttgaaaaccacaccacaacacgcaatcggtagtgttggtttagaattagttaaaaatggtggtggacaaccctttatgggtgagaatgatgccgaaattggttattggattggtgtcccatattggggccaaggtttaatccctgaagcatcaaaagcgattttggcatatggttttgaaacgcttaaacttgataatatttggtgtggttattatgacggtaaccaacaatcaaagcgcgcccaagaaaaattaggtttccaaccagaattgacgattgatgaaatgtataacccattattagatgatacacgtcaagaacacttcacgaagatgaccaagaaacagtggctagcgttgaataattaaatgacactcttaaatacaactgagattatggcgctaattccaaatcggtacccaattatttatattgatactgttgagtcgttagtacctggtgaagaagtggtcgcaatcaagaacgtcacgattaatgagcaattcatgcttggctatcgtcccgattcaccacagatgccaaatacattaatgattgaagctttggcacagacagcttcaatattaattctaaaatcaccagaattctttgggaagacagcttacctaggcgctgctaaaaacgttttgttccatcaaacggttcggcccggtgatcaaatcgtcttcacagttaaattaactaagaaaaaagaaaatatgggagttgtccaaaccaatgcgactgttaatggtcaaatggtttgtgaagcggagctaacctttgttgtggccccgcgtgatgatctcctcggaaaaaagtagatggcctttaaaataattgaaacggcaagtgctttacccgccaacattgtgactaacgacgatttaacggccattatggaaacttctaatgaatggattgaaagtcgaacaggtattttagaaagacggatttcggaaacggaaaatacgtctgatttatgcttacgcgtagcacaaacgttattggacaagagcggtatcgcagtttcacaaattaacgcgattatcgttgcgacgatgacgccggattattacacaccttcaacagcagctattgtgcaggggcgattaggggctgaccaagcgtttgcgtttgatattagcgccgcttgttccggctttacctatgcactatctgctgcgcgaggatacgtacagacgccagatgattacgttttggtcatcggtggcgaagttatttccaaaatgcttgattggtcagaccgtagtaccgccgttttattcggtgatggcgctgcgggtgtcttgttacaaggcactaccgctgaccaagagagttgggtcagtgaaaagctgatcacgattgggacggaaagtgaccaattagtttcaggttacgcaccggttaaacggcctaattttggccaggttggtcaaacgcaagtcgggattgattttttcaaaatgaccggtaaagcaatctaccaattttcaactcggcgcgtacccaaagcaattgaagcagcggtcttagaagccggtttgacacttgatcaaatcgatcacttcttagtccaccaagcgaattcacgcttgattacaaaaatggctagcatgttggatcaaccgctaaccaagtttccaatgaatttacagcactacggtaatacttcggctgccagtattccactattattagcggaacaagtcgaaacaaaccacgttaagcgcggcgatgtatgcgtgctctgtggttttggcggtgggttaaccatcggcattcaaattattcgttattaaatgacacaagcagacatcttaaaaaaagtacaagcagttatcgcagaacaattagacgttgaagaaagccaagtaacacctacaacgaacatccgtgaagatttagatgcagatagcttagatatctttgaagtaatgaatcaattagaagatgacatggaacttaaattagatccagacgaatcaatcgtaacggttcaaaacgttgttgactatatcgaaaaaacaatgaacaaataaatgatggttaaaattggacttttaatgagcggtcaaggtagcgaagccgttgggatggggaatgatttatatcaagattatcccatttaccacgacacgattgaccaagcgagtcagctgacacaacttgatttacaaaaaatcatgaatgatgctgatttattaggtcaaacgcgttatgcgcaaccggcgattgtggctatgagcgttgggattagccgcatgttaacagatacggggatcttaacagctggtgccttagggcttagcttaggggaatattcagcattgattgccagtggcatgcttgatttgacgaccggtttaccgctagttgccaagcgtggtgctttaatgcaagcgactgttgaagcacatcctggcgcgatgattgcgattttaaaacctgatattaatcaaattcaagcagcttgtgagacgattcaaaagactggtgaaacggtgacgattgcgaattacaattcgcccaaacaaatcgtcgttggtgggactcaaagtgggattcaggcgttaacaacgttatttgaaacgcttgaagtagcacctaaagtgattccgttacccgttaaaggggcgtttcataccgctttatttgaagaaacggcgcatcaatttgaacaagcactggcgcaagtcacttttaaagagggcgtttatcccgtgatcagtaatacaactgaacaaccttttgaagttactagcttacaagcaaccttaactgcacagatgtatcaaccaactcattttgcgactggtctgacacaattggctaagcaagaggtgacaacggttattgaagtggggccgggcaacgcacttagcaagtttgcacgtcaaacggtccctcaattagaccgatttaatattagcagtagcgcacagtttgaaactgtcgtggctgccttgaaagaaggcgcacattaaatgacttcaaatgaaaaagtagccgtgattactggtggtagccgcggtattggtcgggcaattgcccttaaatttgcagcagcaggttatcaactcgtgctcaatgcgcgttcagcattagatgctgaactcgtccaagcaatcgaagatttaggcgtgacctatttattcgtacaaggcgatattaccgcagcagataccgctgatcgtttggttaaagaaacctttgaatgctatggtcgattggacgttttggtgaataatgccggtattacgcgcgataagctcgtgatggcgatgtctgttgaagatttccaagcggtcgttgatgtcaatttggtcggcacttttagagtgacccaagtggccttcaaaaaaatgttacgccaacgcagtggttgtattatcaacctttcaagcgtgattggccaacacggtaatatgggccaagccaattacgccgctagtaaagcgggtgtgattgggttcacccaatccgtcgccaaagaaggcgctctgcgtaacgtccggtgtaacgcgattgcaccaggaatgattgaaactgaaatgacagcggtcttaaaaccgagtgttaaagaagcgattatgacgcagattccattacagcgttttggtcaaccagatgaagtggcatcagccgctttatttttagcagaaaatgactatttgacggggcaagttttgactgtcgatggcgggatgacaatataaatgacgagagtagtaattacaggaatgggcgttgtggcacctttaggaaacgacgttgagacatttacacgccggattctagcgggcgaattaggcattggccccattacaaagtttgatgcaaccacaacaggtgtgtcattagctgccgaagttcttgattttgatccggcattacgaatcggcaagaaaaaagcaaagcgaatggatttattttcacaatacgcacttgatagtgcactagcagcactcgaacaagccggtattaacgacgaaaataccgtaccagccgacatgggcgtcatttacggttctgggattggtggtttaaccacgattcaagaacaagtgacgcgtatggttgaaaagggtgctgatcatatctcaccactttttgtgcctaaatcaattggaaatatggctgcggccaatatcgccattgaaatcggtgcgcaaaatatttgtacaacgatcgtaaccgcttgttcaagtggggctaatgcgattggtgaagcttatcgtcaaattaaagagaaccgggccactgtaatggtgaccggtggttctgaagcctcaatcaatgaaattgggattggtggtttcgcggcgttatcaacgttatcaaccgcgacagatccagcacgggcttcattaccttttgacgcagaccgtaaagggtttgtgatgggtgaaggtggcgccactttaattttagaaagtcttgaacacgcacaagcacgccatgcgaccattttaggtgaagtcacaggatacgggaccaattgtgatgcctaccatatgacatcgcctaatccaaatggtgaagttgctgctcgtgcaatgcaaatggcaattgatgaagctgggattacagcggccgatgttgattacgttaatgcacacggcactggaacggttgccaatgagttagcagaatctgctgctttggcacgtgtttttggtgacgaaggaacagttcctgtcagcagtacaaagagtatgacaggtcatttattaggggcagccggtgcgcttgaagcaatcgttacaattggtgctttacaagccggtactttgccaccgaacgttgggttacaaaatactgatccggactgtcacgtgaacttaattaagacaccactagctgccccagacgcacaatatggtatgagtaactcatttggctttggtggccataacgctgtgttgttgttgaagaaatggagcgattagatgaactacgatgaagtcaaagaaatggtggccttgtttaatcaatcaggcaaccaagaaatgcaacttgaaacaagtgatatcaaactttatttaaataaacgaggcgttcaagatgtgcaacacgcgtcagtagcgccatcagtgacacctacaacgccaatgacaagtatgccaactgaggcgcctgaagcacctgtggctgttgccgatgacacagttgcgattgaagcaccgcttgttgggagtatttatttacaaccagcacctgctgatccagcttttgtgaaggttggtcaaacggtagcggttggcgatgtcgtttgtgtgattgaagccatgaagatgatgacggaagtcaaaagtacggtggctgggacaattactgacatcctcgttcaaaacgaagaattagttgaataccaacaaccactatttaaagtgaaagaaggctaaatgttagatagtcaagaaatccaagcgattttaccccatcgttatccgatgttattaatcgatcgcgtattgagtttcgaaccaggtgaattcgcgattgcacggaaaaacgtgtcaatcaacgaagcggttttccaaggccattttccaggtaatccagtattgccaggtgttttcattttagaagccatggcccaaactggggcagtcgctttattaacgcttgaccaatttaaagggcggacagccttttttggtggcgttaagtcggctaaattcagacgggtggttcgccctggcgacacacttgaaattaaagtcacacttgaaaaattaaaagatcggattggggtcggtaaagcgatcgcaacggttgatggtgaaaaagcctgtaccgcagaattaacatttattatcgaatagatgtttaagaaagtattagtcgctaatcggggcgaaatcgcgttgcacatcattcggacgttaaaagaaatgggcattccctctgtatcggtttattccaaagccgataaaagtagtttgcacgttcaattagcggacgaagcggtctgcatcggcggtaatcgaccacaagaatcctatttaaatatgcaaaacgttttatccgcagcgattgggactggttgcgacgcgattcatccagggtatggttttttatctgaaaacagtcaatttgctgaaatgtgtgaagcctgtggcgtgacgtttatcgggccttctagccaagtaattgcgcagatgggggataaaagtcaggccaaaaccagtatgaaggcggccgccgtgccgttgattcctgggagtgatggcccattaaaaagtcttgcggacgctaaaatcgtcgccgctaaagttggttatcccgtaatgattaaagccgtcgctggtggcggtggcaaagggattcgcttggttgacgatgaaagccaactcgctgacagttatgcgcaagcacaattagaagcggccagtgctttcggcaatgatcagttgtacctagaaaaaatcatgctggacgttaaacatatcgaagttcaaattttcagagatcgcttcggcaatgctgtctacttcccagaacgggattgttcaatgcaacgctttaaacaaaaggtgattgaagaaacgccatcggctttattaacgccggttgaacgggctgaattgggcgcaattgcactcaaagcggctgaacaaattaattatgaaaatactgggactgttgaatttttaatggatcaggaccatcagttctatttcctagaaatgaatacccgaattcaagttgaacatccggtaaccgaaatggtgacgggtgtcgatcttgtccgggaacaaatcttggtggccgcaggggcaccattatcatttgatcaagccgccgttgaaacgcgtggctttgcgcttgaatgtcgtttaaatgctgaagatccggacaataactttgccccctcggctggtacggtgaactatttatacttaccaactggtaacttaggtgtgcgtatcgacacacatttattcagtggttacgcgatttcaccgttttacgatgcgatgattggcaagttaattacttggggcgcaacgcgcgaaattgcgattgctaaaatgcatcgggtgctcaatgagttgattgtttcagggattaaaacgaatgcacagttccaacaaacgttattagaagatccggtctttttaagtagccaagcgacgacggattatttaacgtcattagcaacagattaaatgcaattattcaatgccgttcgtaatatcggtaaagcccatcttaaatataatcaagaagcacgacaaaaggtgccagacggtttatgggttgcctgtcctaagtgtcagcaatcgatttatcataaggaccttggttattaccggacttgtccggtctgtcaatatggatttcggacgcgggctaaggttcgcctagattggttggtggatagttttgaaccagccggcgatctagcgcaaacgcctaatccgctccattttcccaaatatccgcagaaattgcgaaaagcacagcaaattaccggactagaagatagtattttgaccggtgtggcaactattaaacaacaaaaattcgcattaggtatcatggacccttattttattatgggaagcatgggcagtgcgactggtgaaaaaattacacggctctttgaactggcaactgaaaaaggcttacccgtgattttaattgcggcttctggtggtgctcggatgcaagaagggattttttctttgatgcagatggctaaaacctcagcggctgttaaacagcatgccgaacaagggctgttgtacattagcttattaaccgatccgacaaccggtggggtaacagctagttttgcaacggaagccgatattattttagccgaacccaaagcggtgattggctttgcgggccggcgtgtgattgaacagacgatgcacgaacagatcgcaccggatttacaagatgccgaaaccgtcttaaaaaatgggtttattgatcaaatcatagcacgtcaggatcaaaaaaaggtacttcatcaattgttgaagttacatgaaagaggggctcattattaaatgaaagaggggctcattattaatcgtcaaaaaaagacagccgctaagattgtcgccggcgcccgtagtagtcaaaaaataacgacaccggcattattggccaacctttttgatgatttaatgattctcaaaggcgaccgagtcggcggcgaagatccagccattattggtggtatcgcgttatttaataatcaaccggtgacggtgattgcaactaataaagggacaacacttgaagaacgtatggcgtgtcactttggttgtcctgaacccgccggttatcgcaaagcgttacggttaatgaaggaagcagagaaattcaaacgtccgattatcactttggtgaataccgcgggagcttatcccggggcgcacgctgaagcgaccggtcagggaatggcgattgccaataatttatatgaaatcagtactctgaaaacaccgatgattagcgtaatcttcggtgaagggggctcaggtggtgccttggcactagcctgtggcgatcaagtttggatgaccactgagagtatgtattccattttatcgccagaagggtttgcttcaattttatggaaagatagccagcgcgctgatgaagcggcggcaatcatgcaattaacaccccaatctttacaagatgccggtgtgattgaagggattattcaagaagaaccagatgaacaccttttctgtcaaaatataaccaccgtcttaaccgaacaattaaatcaattacaacaattacctgtcgagactttattggccactcgacaagccagatttaggcaattttaagtgttaaatggaaagaaaatcctagtgatgggcgttgctaatcaaagaagtatcgcgtggggatgtgcacaagcaattacacaagctggtggggaggttatttatacctaccaaaacgaccgaattaaacatagtttgtcaaaatttgtccccgaaacaagcttattggttgaatgtgatgtcagcgatgatgccgcaattgaacaaacttttgctgaaattaaagctaaagtgggtcaaattgatgggattgttcatgcgatcgcctatgccaaccgtgaagagttagagggtaaggtttatgaaacatctcgttcaggttacttattagcccaagaaatcagtgcgtattcattaatcgccgtcgctaaatatggtcgtgacctcttaaaaccaaatggtagcattgtgacaatgacttactttggttcagaacgcgctgttcctaactacaacgtgatgggtatcgccaaagcatcattagaagctagtgttcgctatttagcacgagatttaggcgctgatcaaattcgcgttaatgccatttctgcaggggccatcaagacactcgcagtgaccggggttaaagatttccgttcattattagaagaatcagaaaaacgaactgttgatggtcaatcagtcacgattgaagaagttgggaatgtcgctgggttcttactcagtgatatggcaaccggtgtgactggtgacattatctacgttgacaaaggcgttcatttacaatagatgacaatcgaggcggcgcagatacagcgggtactttccccggaactacgcgatttgctcaccctctcagttcagcaagtcctaccatcaaccaacgcttatttgttgcaacagccaatgcgtgatcagcaatggtcagttgtggtagcgcaacaacaaacacagggccgcggccaaagagaccaccaatttgtatcgccgattggtggtctttatttaagtcttttgatgcccgttcgagatcctgcgtgttttaatgcctttcaacaaacagctgcagcgggcgttgcacttgccgaaacaattcaagccttgttgcattatgaagttcagcttaaatgggtcaatgacgtctataatcggcggcaaaaattagcaggtattctaacagagggttatctggacgttaccggtcgcttaagtggtgtcgtggtaggggtcgggcttaactttgcctcaacgattgaaactgaacatattggtaacttgcgggcgctagtagtggcacagcaagtcacgattaaccaatttagtgcccagtatctcaatcgattatatacactcttacaattaccagcccttgaactaacacgacgttatcagcgctggacgcctttggttggtcgtaagcttcaatcgattgccggacaaccggttaaaggtctaagtgttagtgcactcaagccagatggtacattaattttaagtaatcaacaaatcgtgcgaattggacaacgagtccggtttgcagattaaatgtcagtatcagttgcgcgccggttaagctatatcggcgtatgtctagccttattaattgtttgtgcccagattagtattccgatttggattgttccgattacacttcaaacactagctgttggactgattgcaaccgtcttaccattacagttgagtagtgcggtaattgcggcttatctattactaggattagttggattaccagtcttcgctaattttgcgggtggggcgagtgttatcgtcggaccgacaggtggttatttatttggctttatcatctatattggcatcgtgcattatggcttgcattattttggtcgttcacggcgcgtgatgtttagtgttaatttactcgctagcctctgtcagttattaattggcacgttgtggttgagaatagcacttcatttaggctggcaagctagtttcttaactggttttgcaccttatgtcccaattgaaatattaaaaagtgggctgattgtggcagtgattgcacgattgccacaacgcattcagcagttccgttaaatgaaaaagcaaggggtattatttggtgcagcggcgctcttattattagcagggtgcagtcaaaaggttgaaggacctaagtcaacagccaaaagcagcagtacgagtcaacaagttaaaacgtcaaaaaaggcgaagaaaacaacaactagctcagctaaaaaggttagtcgcaaacaagtaacacaaacgtcgtcttcagataaggcagtctggtcgtcagccaagtcacaagctttgaagagctatatggctaattttagtcaatcaatgaatcaacaatacgcggactatcaacccggtaatgaaactcatttctttgggcttaactatccaagttactttaaagaagacaaactagctgttgatgatcaacacgtgacagctgattggtcagcagacgggactggcagcagcgattacaatgtcgtggggatttattcagacagtgcggctgcgcacgatatgtcggctcatctatatctatttacgattcatgacggccaaccggtggtcttgattacagaacaaaatcaaggcatgccagatggtcttgtgcacttcaaagaaacagccaatacagatttgaagcaaaactttacacaaattgtcggtggtggctcggcaacaacggctaatacaaccaaaacgccatcatcaactgccaactatcaagtgccgtcagaattagttgggacttggtatggttatagtgagtatagtaagcagccagagcagattgatacgcttgaaatagctggaaataagctgacactgaatggcgaaacgactgaattacatcaagatagtgaacgaacaagtcaagagcgcgaactattgagtggtaaaggtgatccaaatcaaatagataaaaataaaatggataattggggtgttattaaagagtttgatgtcgaaggccgtcactggctcaatgttcgtggttggtatcaaagtgccggggatggtagttattacggtgttaagagccgtaatatcgatggggaaaccatgcctgttttaacgattgctggtggggctggtatgtggcctagtcaacatttatatccaactaaggcagcggcgttatcaatgaaagatacgaaatttgatgatgagcataatcaagaataaatgtttaaatcgcgtgatgaaaaggtagcggcttacgaaatgttactcaagcaacaagcagcattattagaaggcgagacaaatttaattgctaatttggctaattcttcggccttgttgaaccaaacgttaccagaaacggtttttgccggttattatttgtatcaagataatgagttagttttaggaccttttcaaggcaatgtctcatgtatgcatattacaatgggcaaaggcgtctgcggtgaagctgctgctgaacaagcgactgtgattgtaacggatgtgacgaaacatcaaaattacatcgcctgcgactcaacagctcgctctgaaatcgtcgtaccaatgatgaaagacgcgcaattgatcggcgttttagatctcgatagccgcgaagtcggcgcttatgatgcagttgatcaagaatacttagaacgttttgttcagttattaatgcaagcataactagagtgtggcgatttgttttttgaggtggtaacaaacttgggtcacaatcacaattgccaacaagcggtccaagtaatcagttccagcttggacaagcgtgatgctcgcgaattgattgaggccgaggccactgagtagttgaacaatcatgctggaacctgaagacgtaataccgtggaataggaaataagtaatcagtgaactaacgacagtgccgggcaaagcaacgccaatggcaactaacggaatttcgcgtttactacgttgatgttggtataaaaaacaacctgctagtaagccggttaaaaggccatctggtaaatagtatagcgcgaataagtcagtcgtaataccactaagaacgctactggcagtcgccgttaatgcgccagctaagggtcccagtaacgcaccggcaaggattgtcccaatactgtcgaggtaaattgggaaccgtaagacgagcgcaatgttactgccaacgtaatttaaggcgattgctaaggcgataattgttagatggcgcgttttaaattttttcatctatctgagtttttttaagtccgttttaatgattgaagcctgtgcatttaaaacgacggtcaaaaactgttcaaagaaacgatttgtatctacctcagttaaaatgaggctattaataggacggtgccaaaagtcgaagcggtccaccagtgtttggccaatactgatgccggttatttcgacagtggtgtagctttcaaagccctgacaaagtgtcgggtcgatgaaataggcgactgcgagcggatcattaatgacacagccgatgatgtgttcatattgccagtggaaatcaaaataaaactgcgtaatagcggctaaatagtcaccaacttcaggattgatccgctgacaataagctaacaaggtgggcgtgaagacaatctcacgagtgacatctaagccaatcatttcgattttctgattgaggtgttcatagaccgccaaagcagcctccggatcactccaataattaaattccgccactggggagcaattaccatgacttttataggtgccacccatcgaaacgaaccgcgcacaattggcccccaattggggatttaatgttagcgcggtcgcaatgttggtcagtggcccgagtgcgataatactaatatcacaaggtgccttaaaagtcgtcgctaaaaaatcggctgccgattgctcagcggccttggtagtcgtttggcggggaatatgactatcgcccaaaccatccataccatgtgtatcttgagcactaacaaaggtcttcttgagcggctgggccgcaccagcgtagaccgggatgtctagtcgaccgagtcgttctagacatttaaaggcattgtcgacgccaatttcgacggggacgttgccgcaaacaatcgttaaagcaacgacttctacttcaggcgattgaatggccaaattcaacgcaagagtgtcatcgatgcctggatcgcaatcaataataattttgcgagtttgcatatgaaagttgttcaggattatctgacttcctccataggatacagattaattgctaggaaatacggtattaaaagttcttcatctgttcttttttggattcgacgttatgagacctttggtctaaaggggctcgatgtcctatcacctgataaaatatttgatggctcatttaagatgaatgttttaaaatggatgaaaacgaataaggcttcttatccgaaaaccgcacttcattttaatatctcaaacgtcgggaccatctggcaatggcaacatatttgggagactgagggtgctgatgccttatatcgttccaaaggacggcaaacaattatgacagctgataaacaatcgaaaaaacggcagcaaacagaactagaacgtctgagagaagaaaatgaattactacaaatcgagaatgaatacctaaaaaaattaagagccttagttcaggaagaagaagacaacaagcgcaagtcatccaagagctaaatggctaaaagtacgtatgaatacattattagccatgaaccgaacggttcatctgaccaatctgttaaacaagccatccaaacaatcaagaagaatcatccagcgtacggttatcgtcgtgtaactggtgaattacatcgtatgaatatcttagtaaatcataaaaaagtgcttgtcttaatgcgagaactacaattactatcaactgcatttaacaaacgtactcgtaagtataattcatatagaggtaatgttgggaccgttgctaagaacttaatccaccgtcgtttcttcactgatcgtccctatcaaaaactagtgacagatgttactgaagttcgctggggaaccaagacaattgacgaacgtgcctatttcacatgtatttatgatttattctcaggtgaaattcttagccatcaagttagcagacaccctactgttgaatttacaacaactgttttaaatcgagcagttaagaaaatccctaagaatttaaaataccggacaacagtccactcagatcaagggtttcaataccagcatcaagattggactaatatcttgaaagaacatcgcatttttcaaagtatgtctcgaaaagcaacatgtttagataatgcatcaatggagagctttttccatattatgaaagccgaagctttctaccaaaaagaaaccgatacttatgaaacgctagtttcacaaatatcggtttggattgatgattataatttttcaagaattaaaacaaaactgggttgtaaaagtccggttgaataccgaatttttacaacccagaaagctgcttaattatttattgtatgttgtgaaacggtcttcaacagttgcgtattccttagcatctgctggattttcgattgagccaaatggcatttgagcacgaagtttccagtttgatgggatattccatttagcagcaactgcttcatcaatgactggattgtaatgttgcaagttagcaccgatattttgttcagcaagtgccatccatgttgcgtattgtgccataccatttgattgttctgcccaaactgggaagttttcagcatataatggcacgttttcttggaagcccttgataatatcttgatcttcgaagaacagaattgtgccgacaccaccagcaaatgatgctagtttagcttgtgtattagggaagtattcagcgggtgttaatggttttaaggcacttgctgtaatatcattccacaaagtattgttggcttcaccgaataaaataactgcacgtgaaccttggccgttgaaagcacttggtgtttctttgattgtcttgaagattaattctgaaacttcagcttcagttaagtcgatgttttgacctaaagcgtagattgaacggcgttgttgttgtaaatcgaataagtttgtcatttgaaacaagttcaaaatgttattcagcaacttacagaaattagaacagcactaatgaatggtgaaatttatcaatctgtaccagaaaaagtattagccgtcatggacggtgttcaatacaaaacacggcgcacgcacattgcaattccggatgatgcggatgccgctttggcacgaattgctgcaattgaccaacaaatcaaaaccgatggtaaagcagcgcagatatcggatgaagcgttggatgatttattacggcatatggctagtccagatgcacgtgtgagagataagggtgtcttttatctctttaatcggttattacgccaaaccgttttaacgaaagaacaattattatgggttaaagatcgtttgttaagcgatgactatttattcgcccatatttttgaacctgaaaacgatggtgttttcttgcgctcatttagcgcgatgtttctggctggtgttttatacgctaaccggacgttctatcatgtattaacagaagccgagttagtggcgattgaaatgcgcattatggcgtatacggtcattgaattggattcaagagggtatgttgaaaacaagggctgggcgcacgcaatgacgcatattattaacgtctggtctgaactaaacgaaacgaccgaattacaacgggcggataaattattaatgctagtggttgtgatgcaagcttatcgcttctctgataatgcattagcgtatggtgaagacagtcatttaaccaacgtgattatcaatttaatgaagaagaatcggttatacatcgattactttttaatcgtgctgcaagaatggcaacaagcgatgttaaccattgcgccggaagaaaacgtggcgttttggaatcgttggtataaccggaatcgatttttacaatcattgctggtacagccagaattaccagaaaaaattgcggattatttacgtaaaatttctgatttattttaaatgacagtaaaaggtgtaatttttgatgttgatgggatcttagtcaacagtgaaccatattattttgaacaacgcttaacatttttaaatgcaattggggcaaagttaaccgttgaagaaagtcgacgccaaattggctctaacatgaatgccgttttaaaacaggtttatccgggtagaactatgaatgactatgcgatgattaaagagggctatcgctcttataagcgtaaacatccgattcgctttgataaaattttaaatcaggatgcgcagacgctgttagccgagattgcaccgaaatatcaaatcgggttggcctcagctggtgaacgtcaaattattaatcaaatgcttgctgaaactaaactaacgccttattttgaaacaattgtcagtggtgcggagacggctcacaataaaccggcaccggatgtttatacaactgcaattgcacaattggggttaaaaagtgatgaagcagtggccatcgaagattctgagtttggcattaaggctggtaaggcggcgggattaaccgtcattgctttaaaaccgcttgacagtcaatttaaaattaaccaagaagaggctgactaccgtgttgaatctttaaccgaggtaccggctattctggcacaattatcataaatgtcactggggaatttgaagatgatgaagatattaggggaaaactttaaacgaatccgtaagtcaaaaggattcacgcaagctgatttagcgcatggtatttgtacgcaagcgacggttagtctcgtcgaacgtcgtaatcaggtgccgagtacgaaaatcttaatgcagctttgtcaacgcttggaagtctcggtcgataaaattatcgtccaagaagaagatcaattacacgttttaatgcgtaaactacaagatttagcgaatgatgatgagtttgaacaggcgcatcacattattcaacagattcatagtaatgagttagccgaacctgaagattttaaacgttactactattatcaggggcagattagcttattattacaagatagtccggatgatgcactctttttcttccaccgggcttatgaacaatatgtgacgtcacgaacggatacgtatggtgttttatgtattattggtatgagtttggccaatgtgaagaagggtcaattagaccgcgcgcaaaagcaagtcgataaagcaatccgaattatggatagtgaaccgggcttaatgatgattgattttccgaatcatttgcgcatttacggcaccattgctgaaattttctgtgcattaggcgcttatccgacagcacgacgttatgtcaaagaagctatccaagatgcactcgataaacatagtttgtatctattggattatctctacttcgttttaggccaaattgaagttcaacgcgaaaacgaccaaaaagcattgcaacattttcacgttgcccaaacacttgcgcaaattagaaagcatcctttaattttgacgcaagccaacgcacaaattcaaaaattagcataattaaatatcttggccaatactacttttcttcttattgagtgcatgtttattgtcgagatctgttctaaccactaaaacgtcgcaaacagctgtccgagtaacgtattccgttactgaaccgattaataatcgttcaaccgcatttagacctgtcgcaccaatcatgatgagatcgatgtcttttttctcagggacttcgcgagcgataagactcttaggtgccccatattcgatactgtaatcaacgtcggttaagccgaggtcattggcagtaacgatatattcgtccattgttttcttagctgtttcagttacttgttcgaccattgctgaatcgaaacttgaaatgttttggaaagcgcgtgtatcgataacgtgaatcaaatgtaattgaccgttgtttctaagggctacttcaactgcttttctaaaagcaagttcagcttcataagaaccatcaattgcgaccaaaatatgtttatattgttgtaacatttaaagactaccagcaaaagataatgcaacaaatccagtgactaaactagcggcaattacggtgattagattccatgtgaggggcagtgttataaaaataacgaggcccaacacagcaattaataagagtaaccaaccggcaactagcacgcgacgacctaagcgacgattctcagcgaggttgaaaagtaaaaatgatttattttggtagtaacaaagtacaccgcctaatagagcgatgactaccaaaaataaaataaggacaaaagaaatcaatcacttgtggcggcttgcttgtctcagccgttcaagttgttgttttaaaacttgctcgtatttaccagttgctttggcttcgtagtaatgactccctaaaagttttgtcgggaggtaatcttgtgcgacccaatcattgggatagttgtgtggatacttgtagtctacaccatgaccaagcttagcagcaccggcgtaatgggcgtcttttaaatgcgcgggcacttcaccggccttaccggcgcgaatgtcgcctaacgcattatcgattgctgtgatagcggagtttgattttggtgagagacagagatcaatcacggcaactgccaatggaatccgtgcttcggggaaacctaattgcttggcggctgttactgcttcaacggttcgagcgcaggcttgcggattagctaaaccaacgtcttcataagccatcgtcatcaaacggcgactaatggaaggcagatcaccggcttcaattaagcggcccatataatgtaaagcggcgtcaacgtcgctaccgcgaacagatttttgaaaagccgagatgacgtcatagtgcgcatcgccatctttatcatgggtaatggcctttctttgaacgcattcctcaatgacagcaatatcaatgtcgattaaaccagtttctgggtttttaggtgtcgagcggacggctaattctagcgcgtttaaggcacttcgaagatcaccattggtgacttgtgcgaggtatttttcagccgtttcatcgaggttaacgggttcatcgcccaagcctttttgcgggtcggttaaggcccgctggatggcgacgtgaatatcggcttcattaagtgggtgaacttcaaatatctgggtccgactccgaatggcggggttgatcgtgatgtagggattttcggtagtagcgccaattagaacaatccgaccgctttcgagatggggcagtaagaaatcctgttttgttttatcgagccgatgaatttcatcgagtaataaaataacagtgccgctcattttagcttcttcagcgacaatttgaagatcctttttactatctgttgcggcattcagcatccgaaaggcgtattgcgtactaccagcaatggcgctggcaatactggtttttccggtgccaggtgggccataaagaatcattgacgagagtaatttggcatcaaccattcgtcgaatgattttttgcggacccactaagtgtgtttgacccacaatttcatcgatatttgtggggcgcatacgatatgcgagtggttgttgcatatgtccaatcaactatttgaacaaattcaacaattacatttagccccacttttaaattggggggccttcgggattgaaaaagaagggcaccgggtgacagccgttggacaattaagtccgctaagtcatccagcgagtttgggttctcgtgattttcatccgtacattaaaactgattttgccgaaatgcagacggagttggttagcgataccttcgataataccgacgaaatcatgcaacagctaggtgccttatcagaagtacttgagatgaatctagccgacgatgaattgatttggcccctcagtatgccacctgtattaccaagcgatgaaacgacgattccaattgcagacgtcgcaccagatgcgcgtgcttaccgtgattacttagccaagcggtatggtcgtcggctacagatgatttctggcgttcactttaattttagcctggccccagccttaatcgcgcgcttatacgatgaggtctatcatgatcaatttgcaacggtgaaagattttagcgatatgttgtacttacaaatcgcacagaattatagccaataccggtatttattaacttatttatttggtgctagtccgattactgaagcactttttcaaacagatacgacgaacttgccagattatgcagtccgcagtttacgttcaagtcaactctttggttatgccaatcatgacttggtagtctcgtttgaatcggttgctgcgtatcacgattcattggaacaggcaattagtaagaaacaattgatttcagaacgtgaatattacggcagtgttcggttacgtagtcacggccatctcgcccaagacggtgttgattatcttgaattccgcggttttgatttgaatccattcgctgcaagtggtgtgacacaagaacaacttgatttcttacatctgttctttacgtacttattatcgttacctaaggctgttgaaagtttaacggctcgcatggcggaagggcaacaactaaatgaggcgattgcgcttgaagatgcgacgaaagcatcggcacaacaagctaatatgcaaatattgatgactaatatccgtcaatttatcacgacttatcaattggatcaacgatttattgatgcgtggacagttatgaatgaacgagttaatgatttcaaacagacattgagttatcgactagcccaagaagtccaagacgattctctaaccgcttttgccatgcagcaagcacggcaatttaaacgcgaattaaccgagaaaccattccaattacaaggctatacggatatggaattatcaacgcaaatgttaatgctagatgcctttcaaaaagggctccacgttgccgtattagatcgcagtgatcaatttgtcgaattgacctaccaacaacatcatgagttggtgaaaaatggcaatatgaccagtctcgaccgtctaattagttggccgttggtggataacaaagttgttaccaagattgtcttggccaaccaaggtattcgcgtgccagccggtgctgaatatgcggatttagaagttgctaagcgcgactaccaagcggcctttgggcaacgggcgttggtgattaagcccaagactagtaacatgggggccggtattacgacctttttaacacggccatcagaaactgattttgttacagcctttaaactcgcgcaacaatacgaccaacaggtgttagttgaagagtatatcgccggttcagaataccgtttcttagtcatggatcatcaggtgcaagccgtcttggaacgcgtgcctgccaatgttgttggcgatggccgttcaacaattacgcaattagtcgctaagaaaaatcggaatgagttacgtggtgaggatcaccgcacaccgctccaaaatattcgcttaggggctcgtgaacaattgattttgaaacaacaaggttaccaagtcgatgatgtgccaatgcgtgggtcgcaggtcttcttattacaaaattccaatatttcaaatggtggggattccgttgatgtgacggatgatatcgataagagctattttgcaattgctgaaaaggttgcggaaattcttaatctgaacgttaccggtgttgatatcattattcctaatttatatcaaccgtatgatcctgaacatcctgaaatggcggttgtcttagaagctaactacaatccagcgatgttgatgcatcttttcccaatgatggggcaacagcgccgtgtgacaactaaaatgttaacgatgttgttccctgaaatggattaattaatcgaatagacgaccgaaaagcccttcttttttaggcttttccggagtcggtgctgctgatggatatttagcgctaattgcgacagtttcgcaattaatcgcgtctttggcaacgactagtaagccgattgcttctggtgcagtttgcgcagtttcgttattgaccaaagtaaattcaacttggtgtttggtaattgccgcgagataattagtggccgcgtcatttttaccattcaagagaatatggtaagccttgaaatcgggtagatggctttcaaatgtcgcttgaattgcaggttggcttaattcagcattggtgatgctgagtaagacgcgttcgcgcagagagcctaaataccgacggcgttcatcaggattggtttggggcgcgccatggatcgcactatctagatgttgttgcaattgatcgttctctgacaaatgtttacacgtgctgattttgaaatttttgatgacccgactctaaaggggcgtttaaataaaatttatacggaacttgatcccaaatttgaagtatttggggcacaattacaaaatgaactagctgtagctactaaccgcgaatttacgctgcatattgccaaacatttacgccgcttcaaaaatccaccaatgaatacttggatggcgcttagcgagagttcacgtggttacaagatgatgccgcactttgaagttggcttttgggatgaccgaattttcgtttggtttgccctaatggccgaaatgccagacaagacggattatgcaccactattggcgagccaatcagaaaaactcttaagtgattttactgattatgatttaagttatgatcacatgacgaaacaaaaatttccgatgtcaccggataacttacagttgatccaagacaagtttgctaagaccaaaaaaggggagtggttgctcggaaaggtctatctgaaggacaatcctttgtttgaccaccctgaagcactaatggccgatatccaggccacattattaaagatggtgccactttacgaattaataaatgctaaataattatctgttgtagaattcaacgattaaggcttcgtcgatttctggttctaattctgaacgttctggtaaacgaacaagtgaaccttttaagttgtcagcgtcaaattcaacgaatgaaggacgaccaacagtgccttcgatagcgtctttgatgataacaaggttcttagatttttcacggattgaaatttcttgaccaggttttacttcgtatgaaggaatatcaacacgtttgccatcaacggtaacgtgaccatggttaactaattgacgtgcttgtgcacgagtgcttgctaaacctaaacgataaacaatgttgtctaaacgttgttctagtaagatcatcaagttaacaccatgtttaccttcgcgaatcttaccagcgcgagcaaataagttccggaattggcgttctgttaaaccatacattaaacgtagtttttgcttttcgcttaattgcataccatattctgaaatcttaccgcgacggtcgttaccatgttgaccaggagcgtatgggcgacgggcaagttctttacctgtacctgataatgaaattcctaaacgacgtgaaagtttccactttggacctgtataacgtgacatatgctttacattctcataggaatcgtagtcgtcgttttgattggctacttaggagttgctttttatcagcgttacttcaccaaacaaattaagagtttagaagaacgtaagggcgctttaatggcgttgccgattcccgaaaagttgacgaagttgcgctcactacgtttaacgggtgaaagccaacaaaactttgatcgttgggaaaaacaatataatgacattaccaatcataatttcgaagcgattgaagcttatttatttgatgcggaaacagccaatggtaagtatcaattcctattagtagcgcggattttaaaacaactacgtgcctacctacaggaaacggatcaagatttggttgatgtcaaagatgcgctggatcaactattagcaaacgaagctgatacgcgcgaacaaatcgaaacgctgcgggttaagtatcaaggcctgcgcaaacgtctgttgacgaagagcttttcatttggcccaggactagaaggattagaagccattttaggtcaattagaagaagattttaaccaagctaatgaattaacgggtgccggtgattacttaggtgccaagatgatgttacaaaaattaattgaacaaactgatgatttagaagataaaatggcacgtattccgaagcgttatagcgagttagccaatgagttccctgaacaaattgacgaaattagtgaaacgtatcaagccatgttgcgtgaacattataattttggcgataatcaattggaagtgcagctcacacaagtgacagaacgcgttgataagagtttagatttaatggaagctcttgatattgaatctgttgaagccaataatgttgaaattgcgcaaaatattgatcaactctacgcgagtttagaggttgaattaaatgcacgccaaacagttgaggaacatattggtaagactgagacaattgtgtcacacgcgcaaactcaaaatcgcgaactactattagaacttgatcatttgaaccaaagttatgccttaacgcatgatgagttggttactgctaaaaaattaacgaagcaaattaatgagcaaaaagcgatgcttgaaggccatcaaggtaagattgccaatcatgaagccgtttattctgttattgcggatgacttaatggccattgatgagcgccttactgagattgaaacacaacaaagagatattcatgaacaagtttctggattacatcaaggtgaagcagttgctaacgagaatttacaacaattcgaattagaattgcgaaatttaaaacgaaccgtcgaaaaattacacttaccaggtcttgcggatagttaccttgacttcttctttgtcgtaacggatgaaattaaacgcttagatcatgatttaagtcagattaagattaatttagacgagattgccaaacaaatggtacttattcaagatgatctagataagttgaaagtcaaaacaaataatttgatcgatagcgcgttgattacagaacaactcttgcaatatgctaaccgttaccgaattgatttccctgaaattcaaacggcttgtgaagaagcgcaagcggtctttaaccgtgagtttgattatcctaaatcagttgatattttagcaacagccttagaacgaatcgatccaggggcttatacgcaggttgaaaagaactactatagtcaaaaacaaactgatgcattataaatgatttattttgataatagtgcgactaccaagatagcgcccggcgcgctacaaacttaccaggcagtcagcgaacagttttacggtaatccctcaagtttacacgttgtcggcgaaaaagcatttcatcttctagaacaatcacggcagcaaatcgccgatttattgaacgttcaatccgatgaaatctacttcaccagtggcgggactgaaggtgacaactgggtattaaaggggactgcgattgaaaagagtgcttttggcaagcatctaatcacaacgtcagtcgaacatccagccatcatcaaatcaatgcagcaacttgaaaagttaggctttgaagtgacctacttaccagttgataagtttggtcggattaatccggctgatctaaaagcggcgattcgttccgataccattttggtgtcaatcatggccgttaataatgaaattgggacgtgccaaccattaatggcagcggcagaaatcttaaaagattatcctaatatccatttccacgttgatgcggttcaggggatcggtaaaggtatccaaaaagaaatctttaacgatcgcgtcgattttgtaacgctctctgggcataagttccatggcccacgtggcacgggaattttatacaaaaaacgagatcgtcatcttgcgccgctactaacaggtggcggtcaagaacatgatttgcgttctggtaccgaaaacgttccggcaattgccgctatggctaaggcccttcgtttgttattgactgatgaagcacaaaaggttcaaaaacaagcagctattcgtgaacgcatctaccaacatgtcagccaagctgaaaaaacggtgatgttttcacaattgacacctgattttgcaccgcatatcttatgttttgcaatcaagggtgtccggggtgaaacgacggttcatgcttttgaagaacacgaaatctatatttcaacgacgagtgcttgttcttctaagaagggcatggaatcaagtacgttaaaagcgatgcacgttaacgaaaagattgcgacaagtgccattcggatttcattggacgaatataacactttagctgaagcggatgaattcatcaaagcctttgaccaaattaaccaccgtttcaagaaaattaattcttaaatgcaatacactgaaattatggttcgctacggcgagctttcaacaaagggtaaaaaccgtaacgattttatcggtcgtttgaacggtaacgtgacaaaagcacttcacgaatacaagcaattaagaattcatccaaaacgcgatcggatgcacattattttaaatggcgacgatgctgaaggggttatcgaacgtttgcgccacgttttcggaattcaaaacttttcaccaagtattgaagttaatcgcgatttagattctgttaaagaaacagctttggcgatgatgaaagaaatcggtaagcccggtatgaccttcaaagttaatacacgtcgttctgatcataacttcttcttggataccaatgatatgaaccgtgaattgggcggttacttatcagacgaattaccagaattagaagttcaaatgaaaaaacctgatatcacattgcgcgttgaaattcgccaagatgcgatttatttaacaaatcaagtgatccaaggtgccggtggtttaccagttggttcagccggtaaagggatgttgatgttatctggtgggattgattcaccagttgctggctacttaacgcttaaacggggcgtggatattgaaatggtgcatttctttagcccaccatacacaagtgataatgctctaaacaaagcgaaagaattaacggctaaattggtgccatacgttggtggaattaagtttatcgaggtcccattcactgaaattcaagaagaagtgaaacattctgtaccagaaggctacttgatgacgattcaacgacggatgatgctacgtttaacggatcaaattcgtgctaaacgtcaagggttagccatctttaatggcgaatcagttggccaagtggcttcacaaacgcttgaaagcatgatggcaatcaatgacgttacaacaacgccaattgtccgcccggtagcaacgatggataagaatgaaatcatcgaaatcgctaaagatatcgatacgtatgatttatcaatcatgccatttgaagattgttgtacgatttttgcaccaccagcaccaaagacgcgtcctaatttggataaaacacgtttttacgaacaacggatcgatgtcgacgctttaatcgaacgttcacttgctggtgttaaggtaacagaaatcaaagcaggtgatcaattcttaaatcaagacgaagagatcattgccgaacttttatagatgagaacgccaaagcatgatttaccagaagcagttgctaaacggattccaatttattatcgttactttaaactactcgaaacagatggtatcgagcggattaaatcggaacaattggcaaaattggttgccattccttcggcgacgattcgccgcgacttttcttatattggtgacttaggccggagcggttacggttatgaagtgagtcacttaattcaaattttttcagctgttttaaaagccgatattctaactaaaatggccgttatcggggttggtaacttgggccgcgccctaattgaaaacaactttagaagaaatgacaacttacagattacatgtgcttttgatacgaaccccgcattagtcggtcaaattttaaatggcgtaccaatctacgccattgatcaactggcgaccgttattcccgctgctgggatcacaacggcgatttcgaccgtgcctagtgaagcctcgcaacggtcagctgaacagctgattgatgttgggattacatcaattttaaattttgcaccgacgcgtctgcaagtgccacggcatatcaatgtgcgttatctagatttaacggcggaacttcaaactttattattatttgaggaatgaatgactgatcacaaagaaatgtcaaccaaatacgatcctaatcaagtcgaagacggtcgttatcaagattggttaaaagaagatttatttaaaccaaatgccaatccagatgcaaaaccatattcaattgttattccaccgcccaatgttacaggtaaactacatttaggccatgcttgggataccactttacaagatatgttaattcgccaaaaacggatgcaaggttacgatgtgttatggctaccaggaatggatcacgccggcatcgcaacccaagccaaagttgaagcaaaattagcagaacaagggatttcacgttatgaccttggccgcgaaaaattcatcgatcaagtttgggaatggaaagatgaatatgccgcaacaattcatgatcaatgggctaaaatgggcttatcacttgattattcacgtgaacgtttcacattagacgatggtttatcagacgctgttcgtaaagtctttgttaacttatacaacaaaggactgatctatcgtggcgaatacatcatcaactgggatccaaaagcgcggactgctttatcagatatcgaagtgcttcatcaagatgatgaaggggccttctatcatgttagttatccattgacagacggttctggcagcattgaaattgccacaacgcgtcccgaaacattacctggtgatacagcaattgccgttcacccagatgatgaacgttacgctgatcttgttggcaagacggtcacattgccattaatgaatcgtgaaattccaattatcgccgatcactatgttgataaggattttggaacaggggcgcttaagattacaccagcgcatgaccctaacgattttgaagttggtaaccgtcatgacttaccacggattaacgtgatgaatgaagatgcaagcatgaacgaaagtgccggtaagtataacggtatggatcgttttgaagcacgtaaagcaattgttgccgacttaaaagaacaaggtttcttaattaaagtcgacccaatgacgcatagtgttggtcattcagaacggactggtgttcaagttgaagcccgcctttcaactcagtggtttgttaagatgaaaccacttgctgaaatggctttgaagaatcaagaaacagatcaaaaggttaactttgtgccagaacgattcgaaaataccttcacacaatggatggaaaacgttcatgattgggttatttcacgtcaattatggtggggtcaccaaatcccagcttggtaccataaacaaactggtgaaatgtacgttggtgaagaagcgccagaagatatcgaaaactggacacaagatactgatgtcttagatacatggttcagtagtgcgttatggccattttcaacaatgggttggcctaacacagaagcacctgatttcaaacgctatttcccaacaaatacgttggtaactggttatgacatcatcttcttctgggtatcacgaatgatcttccaaagtttggaattcacggaacaacgcccattcgaacacgtccttatccacggtttaatccgtgacgaacaaggccgtaagatgagtaaatcacttggtaacgggattgacccaatggaagtcattgaaaaatacggcgctgatgcattacgttggttcttaacaagtggttcaacacctggtcaagatgtgcgtttcagttacacgaagatggatgctgcctggaacttcattaataagatttggaacgcgagtcgtttcgttatcatgaatcttgaagatacaccggcaccaactaaggttccagaagctgctaacctcgatttaacggataaatggatcttaagtcaattaaaccaaaccgttgctgacgtgacccgtttatacgaaggctttgaatttggtgaagctggtcggacattgtataactttatctggaatgatttctgtgattggtatattgaaatggctaaggaagtgctttatggtgatgatcaagaagcgattgccaataaacgctataacttagcttacgtattggaccaaacattgcgtctattacacccagtaatgccatttgtaacggaagaaatctggcaaagtatgccacatactggcgaatcaatcatgaccgctagctatcctgaagtacatgctgaattagatgatcaagaagcaacaactcaaatgaacgctttgatcgatttaattagaagtgttcggaatatccgttcagaggcaaatgccccattaagtaagccaatcgatatcttaatcaacatccaagatacaccgttgatggccatctttaagcaaaatcaagactttatcgaacgtttcgttcatcctaagtcacttgaaattgcagaaggcctaacagcccctgcattagctaagacagccattatcagtggcgctgaagtttacgtgccattggcagaactattggacttagacgaagaaattacgcgcctagaaggcgaattgaaacgtctaaacggcgaaatcaaacgcgcacaaggtaagttagccaataaaggcttcactgaccgcgctcctgaaaaagtcgtccaagaagaacgcgataaacaagctgattatgaacaacaatatcaatcagttgaaaaacggcttgcagaactaaaagcagctcgttaaatgttggtgacagattacgaaacagctttggcatatattcattcacggccaagattacataaagaagcaaatttaaaccgaatgacccagttattagcggcactgggtaatccacatcagggacaacagtttattcatgtgacaggcaccaatgggaaaggctcagtggtcaatatggtcagtagcttgctggtcgaattgggtttaaaagttggtcgctacacatcgccatttattacccgtttcaatgaacgcattgcgattgatcaacaaccaattgcggatgacgatctggtcgcagttacgcaacatgttcaacagacaattgaaacagtccaacaaacagacgcggactttgaagtgacggaattcgaactgattactgcaattatgttcacctatttcaagcagcaagcagttgatattgcggtcattgaagttggcattggcggcttatacgattctactaacgtcctaacaccattgatttcggtaattacttcggttgggctagatcatcaagccttgctgggcgatacgttggcagcgattgccacccaaaaagccggcattatcaaagcgcaacaccctgtagtgattggcaaattaccagcggaagcacaaaccgtgattgttgaaacagccaaacgattagcaagtccactagcaattagtggggtcgacttttcgacaacagcggttaaaaccttaccaacttgggggcaacagttaaactttcagaatcaaacggtgacacttaagcaacttcaaataccattgatgggcgattatcagattgaaaatgctgcagtagcgttagaaaccttttgtcagtatctagcgttgacgcagcagccacttgatattaagacgcttaagcggggcttggctcacgtgagttggccgggccgctttgaaaaagtaaatgatgaaccgttgattattttggatggggcgcataacccagccggtgttgagcagttggttaaaacagctaagcatcaatttaaacatcaagatatttatattttattcggtgctttgggtgataaatcactggctgggatgttgcctcaacttaatcagttagcaacccacttagtattaacgacggtgccggacaatccgcgagctgctacccaggtgcagtacgcggcagttgataacacgattccatttgaagcgggttggcccgtggcattaaccacaatgatcagtgaattatcggccgatgatgttttattggtgaccggttccttgtacctaattagtaccattcgtagttattttaaaggagtgtcatagatgcaaactagagggattatttttgacatggacggcttattagtcgattcagaaaaagtttattatcaagctaaccaattagcggcgcaaaaaatgggctttgaggtgacggcagaagaccatcaagccattctggggacgacagatacttatttacgccaatatttcttacagaaattaggctcaccggaattagtgaagcagtttattgatttgtcttatagaacagttgatgaaattattcaagaccaaggggtagccattaaaccggggttagtagaattattggactactgtgacaatcacgggattaatcgggtgattgcttctagtaattttagaacaatggtcgaagatttcatgcaaagcacagggttaaagccccgtttcaaccagattgtctcgggcgatgaagtgacacacggtaaacctcatccagaaatctttttaaaggctttagataaacttgccattccagcccctagcgctttagtactcgaagattcaccaaatgggattttagcggctagcaaggctgacattccagtgattatggtgccagatttgattgccccaactgccattactaaccaacaaacattggcaacggttgataatttagcagccgttattccgtttttagaaaaataaatgttaacgagtcaatcaaagttacaacccagagagcaagtcgcactgtatggtgcggccagtctaagtgatgaacaattagcaaccgtaattttacgttcaggcacccaacatttacccgttgaagtcgttgcacaacgattattgcaacgctatcccgactttcaagatcttgaacaagcggacttagtacaattacgtcaaatcgaaggtattggaccggttaaagcgattgaactccaagcgatttgtgagttaagtcggcgcattcaaaatcagcggacattacgttttggtgtagtggcttctagtcagatggtaggccaacggatgattgaatccttagcgggagagacacaagaacagctattagcggtctatttagatgttaaaaatcagattattcagattaagcaactctatctgggtacacttaatagttctgttgcacatccgcgggaagtctttaaatgggcggttcagtattcagcggctaagtttatcttggtccataatcacccgagcggtcaattggcaccatcaacgcaagatattaactttacaaaaagaattgttaattgcggacagttgatggggattacttgtttggatcatttaatcattggtagctcacagtacttaagcctacgtgaagaagggtatctagtcgattaagtgttcggattagggactagaaatattggtatcgacttaggtaccgcaaacacacttgtatatatggacgggaaagacattgtcttaagagaaccctctgttgtcgccaaaaatacacaaacaggcgaagtcatcgctgtcggttccgaagcacgcgacatgatcggccggacacctggtaatattgtagcgattcgtcctatgaaagacggcgttattgcagattatgatacaactgcagcaatgcttaaatattttatcgaaaaaacaatcggccattcatcaagtaaaccatttgtaatggtttgtgtgcctagtggtgttacagaagttgaaaaacgcgccgttatcgatgccactaaagttgccggtgcgcgtgatgcttatgtaattgaagaacctttcgcagccgcaattggtgcaggacttcctgtaatggatccaactggtagcatggttgttgatatcggtggtggtacaacagatgttgctaccatttcattaggtgggattgtctcaagtcgttcaattcgaatggctggcgataagtttgacgacgcaattatttcttacatccgtcaaaacagtaacctattaattggtgaacggacagctgaacaaatcaaattagcgattgcttcagcttcaccagaacgtgctaaagaagttgaatcaatgagtgttcgtggccgtgatttagtcactggtctaccaaagactgttgatattaaagcaagtgatattgccgaagcaattaaggaaattgtgacagcaattatcgatgctatcaaagaaacgcttgaagaaacatctcctgaaattgcagccgatgtgattgatcacgggattgttttaactggtggtggtgctttattgaaacatttaccagaagttatctctgatgctactaaagtacctgtcttcattgcccaagatccattggactgtgttgcagtcggtactggtgaatcattgaagaatatcgaagtcatgaaaaaaaattaaatgcaaaaattcttttcaaataaaaagttaatcattttattggtgacattaatcgtctgcatgggctttatcgcaatgtcagttggcttgcgtaatagtaagaagagtccaagttttatccgtcaattcggaaacgatgtgacaggcattacaaaccaagttgttagtgtgcctgctaatgggattggtaaaggtgtcgatgcactgacagacttaattaatacttatcaagaaaataaagccttaaaagcgcaattagatgatttagcacaaactaaggtccaagcacaaactttaaaagaagaaaacaagaacttgaaaaaagaattaaacttagcagggactttaacagactatacgacgctcaatgcttccgtgttgtcacgaaatccggataattggcagaattcactggtgatcaataagggtgctctagcaggccttaagaagaatatgccagtgatgtctgaatcaggcattatcgggcgtatttcagaagttaataagaccaatgctaaggtggaactcgtttcaagcactggtcgtaacagtaatggttttgccgcagtggttaataccaaagatggtaaacaagttaacggtattatgacgggctataattcagataaaaaacaattgaaattaggtcaaattaaaaccgatacagcgattgctaaaggcgataaagttgttacttctggcttgggtggtttaacacctaagggactttatttaggtaaagtagcttcagttaaaaaggacgactatggtttggcattaaccgtgtatgttacgccagctgctgatctgaataacttaacagttgtaacggttatcaaacgttcgattgaaggtgagtaaatggggacatttcgcttgaaacatcgctatttaatcccaatttacttactagtcgctttttacctggatggtgcgattagttcattaggggaacaatggctatatacgccagatcataccctaattagtcggttattcatgttaatgtttatcatggttgcgtttgttctgcctgaagagacgaatttatcatggtatgcagtggggattggtcttttgtatgatttatattatacggggatgattggcatgtatctttttgtattgccactgattatttatatcgtgcgttacttaaaacaatacattccagattcaccattctttattgggttagtcgacgttatttgtttaacgttgttggaggcctcaatttatattatgaatcggctcgttaatttaacgagtatgacaccagttgatttcattagtaacgttttagcaccgacaattgcattaaacttagtcttttttatctttttgtatttgcctttaaagaaattattgctaaaattaaaatcagaacgatgaatggatgcagtcacgttaagaggacgcaaagaaggattcgaattaaacattgatgctggtgccgattttgatcaagcattagattcaattgtcgcattattgagtaaaattcgctcagaacaacctaagttgggtaatgataagattgaacttgagttaacaactgggatgcgtttattaagtgaacaacaaaaaaaggcgctatatcaaacactagaaccattccctgagtttgatattatgagtattcagtcttcggtaatgacgattgagcaagcccaaattgaacggcaagaaaatagtattcatgttgaaccgaatgttattcggagtggacaagaagttaactatgtcggtgatgttttatttgttggtaatttacaccaaggggctgtcatcaaagcgacggggagtattttcattctagggtctgttgcagggattgtgcatgctggttttccagataatgcagatgcaatcgttgctgggaacctgacgaaagctgtccaacttagaattgcagatgcggttgaaattatcgatccaaagaaaacgccctttaattcacaaagtatcagttatattaacgatttacacgtcatcgattacggtgagataacggatttaaaacaaattaatcctaaactatatcgtaaaatggaggagcaataaatgggaacagctttggtcatcacatccggtaaaggcggtgttggtaaaacaacctcgagcgctaatattggaacggcgcttgcgcttttggataaaaaagtttgtttgcttgatttagatatcggtttaagaaatttagacgtcgtattgggattaagcaatcgaatcatctatgatatcgtggatgttgccaaaggccgtgccaaattacatcaagcgttgattaaagataaacgctttgatgaaaaactctatttattaccagccgcacaaaacacggataaagaagcactcgtaccagaagatgttacagcgattgtgacggctttaaaagaagaatttgattttgtcatcattgattgcccagccggaattgaatcaggctttaagaacgcgattgccggcgcagatggtgcgattgtagtcgcaacgcctgagatttcatcagtaagcgatgctgatcgtgttgttggtttgcttgaagaaactgaaatgcaaatcgcaccacgtttggtcatcaatcgcattcgtcgtcatatgatgaacgatggtgaaacaatggacgtcgatgagattacgaaacatctctcagtatcattgttggggattgtttttgatgacgacgccgttatcaagacatccaatgctggtgaaccgattgtcttagatcctaaaaactcggccagccaaggttatcgcaatattgcccggcgcctattaggtgaaacagtgccattaatgacgttgaaagaaaagaaaatcggtttttggggtcgactctttggtaaaaaatagatgcaatatagtttatcgattttaccagcgcttttgagtggcgctaaaatgacgttagccatttttagtttaaccgtgattggtgccattcccctggggttattattgagccttgggttattatctaaattcaagccactgcattatttgcttaacctgtatgtttggctaatgcggggaacgccattgctattacaattgatctttgtcttttacggcttaccggtgattgggattgtctttaatcgtttcgacgccgcattaattgcatttatcttgaattacgccgcttacttcgctgaaatcttcagagggggctttcaagcggttgatgatggtcaaatcgaagccgcatcagttttaggattaacctatccccaaaccattttaaaaattatcgtgccccaaacggttaaaatcgttttaccgtctgtcggtaatgaagtcattaatttgatcaaggattcatcattagtttatgtgattgggattggcgatttattacgggcaggaaacgttgccagcgcgcgtgacgttaatttagtgccattgctgttagtgggtgtgatttatctcgcattaaccgccatttgtacatggttgttaggccgattagaacaatattatcgttattaccgttagatgtttaaattagaaaatattaatcagtcattcaagggtcgccaaattttgaatgatttaaatttagaagttgaaacgggcagtattttagcaatcgtgggtcctagtggcgccggtaaatcgaccttgctccgcttaatcagtgggttggatcaaccagacagtggccggttcgtgattgacggtgaaacctatgtcccaagtgccgctgaaaaagggggccggataggtgttgtcttccaagatttccgcttattcccgcatttatcagtgttagaaaacgtcacgttagcgcctaagatggtgaagcaattggctaaggacaaagcgaatgcattaggtcagcaattattacgccaattaggattaagtgcacaagaggcggcctatccgtttcaattatcaggtggtcaacgacaacgggttgcgattgcgcgcgcgttagcgatgcagccggatattttgtgctatgacgaaccaaccagtgccttagatccatcgttagtcgctagtgtggcagaattgattttaagccttaaggaagacggcatgacccaaattgttgtcactcatgatattcaatttgcgaataaaattgccgatcaagtttttgaattacaaccaaacgaggccaaccaatgaatgatgagattaaagagattagcaacagctggtttattattaggcctattagtcagtctagcgggctgccatagccgccaaaagaccgatagttgggcaacgattgaacgccgccaaaaagtagtgattggcatcgatgatagctttgtaccgatgacttatcgtgaaaaaaacgggcaattaaccggctttgacgtcgagttagccaaggcgatttttaaaggtagtggcatccaggttgattttcaatcgatcgattgggatatgaaagaaaccgaattgaacaatcagacgattgatttaatttggagtggttattctaagaccgaagaacgggccaaacgagtggccttcagtcaaccttatcttacgaatcaccagatgattgtctcgatgaaaaaggatcctgttaatcgcttagctgatttgaagggccaaaacttaggtgttcaaacgggttcatccggcatggcccagttggatcgaaaaccagctgttttaaaacaaaaaattgccaatcaaacgccaatcctatatgatacctataacaatgcttttatcgatttacaggctaagcggattaaagggatcttaattgatcaagtttatgctaactttgagattaaagcgcgggcaaatgggcaagattttcaagcgattgaaagtccttttgcggctgagaagtttgcggttggcatgcgcccagaagatcaaaaattacgacgctttattaatcgccggtatcaagtcctcaaacaaaatggacaattagcgaagattcaagccaagtggtttaaagaatagatgacgacgattattatcataattcttagtctcatattagtaattaatacaatcggtgcgatcattaccgtttttcgacaatcaagagatattgcggcgacttgggcctggctactcgttttaattttattgccagtgatcgggtttggtttttatctcttttttggtaagaaattatcagcagagcacctttatgatttacggacacaggccaaattaggcattgatgaacgcgtgacgcaacaaaaagcggaattacggcaacgacggaagcaaaatcaccattctacaacgccggagattcaaagcttaattaatctcttcctagtgtctaatacagccgttttgacgcaagaaaataaggtatcggtcttaacggacacaaccactgcccaagagcgactactggccgatatgagccgtgctcgtgatcacatccatttagaatactatgcgtttttcgatgatcctttcgggcacatcttaattaaaacgctcgcctataaggcatatcaaggggttaaagtccgcgtcatttatgacggctttggttcgcaaaagattccacgctctttttttaaaccattagaagaagcgggtgggcaagtaacgccctttttcagttcgcggtttcgtttgattaattttcggttgaattttagaaaccaccgccaattagtcgtgatcgatggtaacacggcctatcttgggaactttaaccaacatagtgttgatacgcatttgccagttcgagacacgcgcttacgaattagtggcgacggtgttttatcgtttcaatcacgtttttttatggattggaacgcggcaacacaacgccagaaggtttattacagtcagcattatttcccgacttctgtcgaacatggacaaactagcatgcaacttgtttcgggtggccctgatcgcgatttacctgaaattaagcttggttttttaaagttaattgcggccgctaaaaaacggttatggattcaaaccccattttttattccggacgattccgttttggcagcattaatacttgccattaattctggggtaacggttaaaattatgattcccgaaaaagcgaaacatagtttagtccaacatgctaatctctactatgctaggcagattgttaaagcgggcggacagatttatctatataaagcgagtgcttttagagcacggacgatgatggtcgatggtcagttatcagctgtgggaacggctaatttagatattcgtagttttaaacttaattttgaaacgaccagctttttatatgatcctgcattgaccaatacgttagaattgacctttcaaagggatttaaaagcaagtgtaccgctgactaaacaacagttaaatgcacaaacaacaaatcagcgactctcgcaagatttagcgcgactgttggcgcccattttataattatttgaaatagttttgtaaaccagcgtaaacggcatccgccactttttcttgataactactactactgatgtaattaaagtcttgatcagaattgatataacccatttccaatagaacagaagggcgttcgttatcacgaagtacttgataattaccgtattcaacaccacgattagttagtggtaatgatttaatctgattattaagcgcgttggctaagctagtgtccttactatttgagtaataataagtagttgtgccactcgcttggttagattgcgcactggaatcaaaatgaatactgataaaggcatctgcacgtaatttattagaaagtgcaggccgaggtgctaaatcaacgaatttatcagacgaacgggttaagacaacgttggcgccggcggcttttaacttcttagcaatcgcatcgacggtcttaagcgtataagtcttttcgtatttattactatttgatagcgccccaacatcgttaccaccgtgaccggcatctaaaacaatggttgcctcagaaagggaggtagcacttgttttaacgacttcgttcttagcagaaggggtgacgacccaactggcgacataacccgtattaccgtccgcgtctttaactttgtaccaagtgtctttcttatcgagatacgttagcttcgtgttggcggaatagacttgagaataggcgtagttgacaccaggaccgcttcgcaacttagtattatccagttgcgttgtgacggatttaatatcagaagtggattgactgctactatcatctgttttcgtatccgtttgaacagctgttggtgcttcgttagaaatactaatcaggtcactttggacccaccccacagctgaattatatttaacttggctccaaccgttttgttggtagagaactgttaacttgtcgcctttattgacttttcctaacagggggctgctggcattgctgctttggcggacgtttgcaaaatcattggtgacagttgcgacccggttagaggttgcgctgacttccgtattattgaccaaccaactggcaacccagccaattttatcgccacttaagcggacttgataccagttattcttttgtgaaatgacgttcatcacttcgcctttgcttgcctggcccattgtatcgtaggaaagaccgggtccttggcgcacattaacgacgtttgctttaatggtaatttgttggtacgttgcaaggacgtgtgtcgcgaagagaccgacaccaactagaatgaataatatgagaacggcaggataccgttttatccagttcaaaggtttttgcatatgggttatcaaaagccaaaaggcacagccgatattttgccaggagaatcagatcaatggcaacttgttgaaaaaacagcgcgcgacgtttttgcgcgttatcaatttaaggaaatcagaacaccattattcgaaagctacgatgtcttttcacgaagctcaggcgatacatctgatattgtcagcaaagaaatgtatgatttcatggataaaggggatcggcacattgcgttgcgcccagaaggcacagccggtgttgtccgcgcctttgttgaaaacaaattatatggtcctgaacatcaaaaaccttacaaagtgtattacatgggtcctatgttccgttatgaacggccacaatcaggtcggcaacgtcaattccaccaaatcggcgtggaatcatttggttctgaaagcccagcagttgatgttgaagtcatcagcatggcaatgcgtctgttacgtgaatttaaaatcactgatttgaaattagcgattaatacactgggtgatgctgctagtcgggctgcttatcatgaagccttagttaattacttagaaccacattttgatgaactgagtgatgactctaaagttcgtctacacaagaatccattgcgggttcttgatagtaaagatgcgaaagatcaagaaattgtcaaagatgcaccagtcattcttgattatttaacggatgaagccaaagtgcatttcaatacagtgaagactttattagaatcattaaatattccatacgaagttgatactgaaatggttcgtggtttggattattataaccacaccatctttgaaatcatgacgaacaataaagtcttgggtcgcggctatacaacggtcttagccggtggtcgttacaatggcttagttgaacaattaggtggtcctgacatgccaggggttggttttggccttggtgttgagcgcttattattattgatgaacgctcaaaatagtgacttagtagcggcacctgtgttagatgcctacgtggttggcatcggtgctgaaacgagtgcaacaacgctccacttggttgaaagcttgcgggaagctgggttgacagctgatcgtgattatttagatcggaaaccaaaagcccaatttaagacagccaataagttaaacgcccaatttgtggtgacaattggtgaatcagaattagctgataagacggcccacgtgaaggatatgaccagtggtgttgaaatcacagtgccattgacgatgctagaagccgattttgcagcagttaaaaatgaactaaaagcacaagaggagaatgcataaatgaaaacaagaacaacttacagtggtttagttgatgaaacatttgttggtcaaacagtcacattacatggctgggttcaaaaacgccggagtttaggtaatttaatcttcgttgatttacgtgatcgtgaaggcttagtgcaattagtctttaaccaagataatgctgatatcttaacgcttgctaacactttacgtaacgaatatgttattgaagtgactgggacggtgcaagcccgtgatgaagcggctattaacccagatatgaagactggtaaagtagaagtcatcgtgagtgaattaacgattttaaacgaagctaaaaacttaccttttgaaatcaaagatggcatcacaacttctgaagaaacaaaattaaagtatcgctaccttgatttacgtcggccagaaatgcaacaagcaattattcgccgttcacaaattacacaagcggcccacaaatatttagacaataatggtttcttaaacattgaaacacctgatttaacacgttcaacaccagaaggcgctcgtgattacttagtgccatctcgtgtttatccaggtagtttctatgccttgccacaatcaccacaagtcttcaaacaacttttgatggatgctggctttgatcgttactaccaaatggcgcgttgtttccgtgatgaagatttacgtggcgatcgtcaaccagaatttacacaaatcgatgttgaaacatcatttatgagtgccgaagaaattcaagaccaagcagaaggtattatcaaacaagtgatgcaagatgttatgcatattgatgtcccaacaccattcaaacgaatgaaatggcaagaagcaatggatcgttacggttcagataaacctgatatccgttttgatcttgaaatccaagacttaactgaaatgatgaaaacaagctcatttaaggtcttcagtgacactgccaatagtggcaatctggttcgtgcaattgtggtcccagaaggtgctgctaagtactcacggaagatgttggacgaacaaacagaatatatcaaacgttacggtgctaaagggatggcctgggtcaaagttgttgatggcgaattaacaggaccagctgccaaattcttaaaagaacaagaagctgaattgcttagtgccctatcagcaaaagatggcgatttagtgctctttgtagctgataagttccaagtagtctgcgatagcttaggctacttacggaaacactttgcacatgacatgggcttagtggatgaatcacaatttgcctacctttgggttgttgattggccattatttgaatatgatgaaggctttggtcgttggattgcagcgcatcatccattcacacgtccaaacgatagcgatgttgatttattggaaactgatcctcataaagcacatgcgcaatcatatgacattatcttaaatggttacgaattaggtggcggttcactccgtatctaccaacgtgatatccaagaaagaatgttcaaagcacttggtatcagtccagaaacttatgaagaacaatttggtcacttattaagtgccatggattatggtttcccaccacatggtggctttgccattggccttgatcgttttgcaatgttactcgcaggccgcgataacattcgtgacgtaattgccttccctaaaaactcacatgcttcagaaccaatgacgaatgcacctagtcgtgttgcaccagcacaattagatgaactcggcttagaagttgaaccagaggttgaaaaggattaaatgagcgatgatttacgacaacagttaacaccagagcagtatgcggtgacacaggagaatgcaactgagatgccatttagtggtgagtacgatgaatttgatcaaccaggtatctacgttgatgttgtcagtcatgagccgctatttagttccttagataaatatgacgctggatgtggttggccctcatttacgcgaccaattactaagttaaatgaaaaacgagatcaaacacacgggatggaacgtgttgaagtccgtagtcaaaacgccgattcgcatttaggccacgtttttacggatggtccgcaagaacaaggtggtttgcgctattgtattaattcagcagccttaaagtttattcccaaagatgacttaaaagctgcagggtacggtgagtatctcgcgttatttgaaaaggagggtcaataaatggcaactgaaacagcaatttttgcaggtgggtgtttctggtgtatggtccatccgttcgatcaacaaccagggattattaaagtggtctctggctacaccggcgggcacgtcgctaatccaacctacgaacaagtttgttcccatacaaccgggcatacagaagcggttgagattacgtttgatcccgcagtgatttcgtatgctgaactagtcgaaatctattggcgccaaacagatccaacagatacgatggggcaattccaagaccgaggcgatagttatcggccagtgatttttgttaattcagatcaacaacggataattgccgaagcatccaaagaaaaattgattgctagcggtcgatttaatgaaccaatcgtgacgcaaatcgaagcagctaaaccattttatcctgctgaagagtaccatcaagatttctataaaaaggaaccctggcgagcagaattaggagaagtcaagcgaaaagccttcattcgagcaaaatggtcggattaagtggacgatctagcgcgaaaacatcagaatatggccaaagtttcggcggctatcttatatgggatttgtgtgtcaattgcattgaactttttctgggaagaaggcggcgtgtacgcctcgggcattaccgggttcgcgcaatttattcataccgtgacggcgaagtttatgccgtttctaccattcccattatcaacttccttgatgttattcttgctaaacgtaccgctttttgttttagcttggtttaaaattgggcatcactttacaatttatacgtttatcgctgttattttttcaagtttaatggtccaaattatgccgctgacccaattgacggacaatccaattatctgtgcgatttttggggccgttattaacggttttgggaccgggatggccttgaaaaatgatatttcaaccggtgggttagatatcatcggaattgtccttcggaagaagaccgggcgttctgttgggaccatcaatattattttcaacgttgcgttagtctttgcggctggctttatctttggctgggaacatgctttatatagtatcttgagcatcttcgtcaatggtaaggtcatcgatatggtctatacgcgtcaacaaaagatgcaagtgatgatcattacggacaatcctaaagtcgtgattcaaatgattcaagacgagatgcgtcgcgggattacgattgtgcacgacgttgaaggggcttataaccgcgaagaaaaaacgatgttattcaccgttatctcacgctttgaaatgcatgaccttgagatggtcatgaaagaagccgatgatcacgcttttgtcagcattacagaagcggtcaagattctggggcatttctacgaaccgaaaattaaataaatgttattaggtagtcacgttagtatgaagggcaaagaaatgctgttaggttcagcgcaacaggcggctgagtttggggcgaacacattcatgatttataccggggcacctcaaaatacccggcgtaaaccaattgaagagttgaatattcaagcagcacaagaattaattgcagccaaaaacttaggcccgattgtagtgcatgcgccttatattgttaacttaggcaatacagtgaaaccagaaaactttaaatttgcaattgaatttttacagcaagaagtcattcgagctgaagcgctaggcgcaagccaaatcgttttacatccgggtgcacatgttggtgcaggcgcagatgctggtattaaacaaattattaaagggttaaatgaagttttacgaccagatcaaacggctcaaattgccttggaaacaatggctggcaaaggaacagaagttggccgtcgttttgaagaaatcgctcagatgattgatggcgtaacgttgaatgataagttgtccgtgacgtttgatacttgtcataccagtgatgcgggttacaatattcgcgaggattttgacggcgttttaaacgaatttgatcatattatcggtttggaccgacttaaggtgatccatttgaacgactctaagaatccacaaggggcgcataaagatcgacacgccaatatcggatttggcgaaattggttttgatgccttacacggtgttgtgacccatccacagcttgttgatgtccctaaaattatggaaacaccatacgttggtgaggataagaaacataattttgcaccatatgcatacgaaattgcgatgctcaaaaagggcgaatttgacccagaattattaacgaagattgagcagaatgaaggtcgattatgaatgagattgaaacgttctcgctatctttggctagcgctaatggttttaccggtattgttattgctggtcaaaccggtgcaagcagccgatacgtatgatattagtcgctatcatgttcaggttaacgtccaaaaagacggtagcgcactagtagaacaaaaaatgaattttgatattcaagatgatatcaacggtatttatctcaatcaaaatttacaaacaaccgttggtgagcctaaaaagttggtgcagccacaagtggccgttaatggccggactttccaagcgagtcaatccgagacggcggggacgtattcgctaacagatgatgatcaaaagtatcgtttcaagctctaccaaccagcgacagaagatgatcggttagcagtcactttgaaatatcagttacaaaatctgattattaattatcaagatactgcggaattaaactggaaagtgataggggatgcctgggacagcagtctgggcgatgttcaagttacgattcaattaccgacaactctgaaacagtctgaattaaagtcgtggacacacggtgatttagatgggcaacagattgttgatccggcaaaagggcgggttaccatcaagatgacaaataacccggccaatcaatttgttgaatcccatcttatttttccaacttcagttaccccaactaaccccaatcgggtggctaaaaagcaacgggcaaccattatcgctcaagaagcgaaacgggctgaagaagccaatcaagcacgtcaggcgcaacaacggcggtattgggtgctttcggtgattgcagtggtcttagcgccagtcttattgttagtggtttggtatcgggttaaacgggcattgccccggatgcattatcagggtcatgcgccagaacacgtctacgacctaccagatgataatggtccagccgttattcgttatctattagcactaccaatgacggaaaaagcaaaggaagaaagtttatcggctactattttagatttggtagcccgtaaaaacctgacaatcgaggttcaaacaccagaaaaacaagttttcagaaaagcgaaaccacaatttacgttaactttgttaaatcggaatcgattatcacgttctgagcaaaaattagtgacctggttattcgatgtcattggtaacggacaacaggttagtctttttgaaattgaaaaatatccgaaacgtcatagtgaaaaagtctttaatcaacattatcgcggttggcaaatggcggttgaagatgaagcaaaccaaagtggttggctacgggaccgtgtttttgccgttgcaaccagtttaaattactggttgataggacttggtacactaaccgtgattttaatgttagcagcgttaatcgaagtcgttgcttggtggacgattttaccaatgttgatagtctttctcctaacgggctggcagaggctacgattgcaattatggacgcaacacggttatgaaaaacggggcgagtggttaggctttaaacagatgttgaaagacatttcgacacttgatatggccaatgtacctgacgtgatgttgtgggatcgttatctgagttttgcaacggcattcggagtagccgataaagtggttaaagcgttgaagattaaattgactcctgagcaactacaaacaatgccattaggttattattattactacggctatactggtggactcaatattggtcaatcctttacaagtgcccttagtagtagtgtgaatagtgcggtgagtgctgctaatccaaccagtgtcagtggtggctctggcggattctccgggggttcatcaggtggttttggtggcggttccggcggtggtacattctagatggaattcaacgatgttattaataacagaaagtcaatccgctcgtttgatcctcacaaaacagtatcagatgaattaattaaaaaaatcattacctcagcacaacgcacaccatcatggacgaattcacaaccttggcgagtttacgtggcaactggtggaacacttgctagtatcaaagcagatcaccttgaacggacgcaaaataaggttaagggcaattctgatttagcagtgattcatcgtgttgattggggtcaggcgatggttgaaaatagtcgggtgtggaatgctgaaatcagtgattatttgggcgaagaaggtttagcagcatttagcgatttacaaatgcatctttttaacgcaccagccgttatctatttgacggttgaacgcaaagtctcaccgtggatgatttatgacatgggggcctttagccagtcaattttactgtcggcggctaatgaacaagtggacacgattccggcttacgaaacagctaaatatccggatgcaattcgcaaaattgtgggtattccagacaatgaagtaattattggcggtattgcgatgggttatcgcagcgaaggaaagattaatcaattccacgctaaacgaagtgcacttgatcatttcttgacgattaaacattaattaattaacgtgatctgtcgagctacttgcaaaatctaagccagtttgttcgagaatgatagccgctgtttcttcgattgagcggttggcgacgttgatgacttggcaaccaattttgtcatataaatcttgtgcgaagtctaattcggctttaatttcatccatatcggaataggttgtgtcaggatttaagccataggcaatcatccgttcacgacgaatattatttaaaacttccggtgtattcattaagccgataatcttcttaggatcaacatgccatatttcgtctggaatgtgcgcctgtggcacgattggcaaattggcaaccttgatgttccggtttgctaaaaacagcgacagtggcgttttagaggtccgagagacccctaataagacgatgtctgcctctaagaagccatggggatctttaccatcatcgtacattacagcaaattccattgctgaaatccggtcaaagtagcgctcgtttaaatgatggagtgcgccggcttcacctgatggggccaaacctgtttgagccgtaattaatttagaaagtgggctcatcatatcaaatgacgcaatttttttagcgtcacaataattttgagcaatttctgaaaggcctgttgtggctaatgtatgcacaacaattgtttctcccggaacagccttgcttaaaacgtcagttaatttatcaacggaatgcacaaatggaaaacgaataatatcgggtttaatgtttggatattgcgctaaggctgcttgcgcaagttgtaaagcggtttggccaactgaatctgagaggacaaaaaccgttaagggggtagactgtgacatatgggcaagacagtcgttcgcagtaacgaatctctagatgatgctcttcgtcgcttcaagcgttccgtatcaaaagctggtacaatacaagaatatcgtaaacgtgaattttacgagaaaccaagtgtaaaacgtaagttgaaatcagaagcagcaagaaaacgtaagaaattctaaatgagtttacttgaacaattaagttctgatttgaaaacggcgatgaaggccaaggataagttgcgactaacagttattcggagtttaaagaccgctttaactaacgcaaaaattagtgcagggcaagacttatcttctgacgaagaactaagtgtattatcatcacaagttaagcagcgtaaggattctttagctgagtttgaaaagggcgatcgtgcagatctcgctgaacaaacaaaagcagaaattgaaatcgtacaagcttatttaccagaacagctggatgaagccgctgtgattgtaattgttgatgaagcaatgcaggcaacaggagcgacaggcaaggctgactttggtaaggtgatgcaatatgtaatgcctaaggtcaaaggacgagctgatggcgcaatggtcaatcaagtcgttaaatcaaaattgagttaattggttgaggtagaagagcgtttatttcaattagcaacgcctaatttggcggctgctttaatgggtgcacacgatcactttttaaaaatcattgaagaaagtctaaccgttgaattgattgcgtttgatgatcatattacgattcgggggactcagccggggttaagacaagcaaacgcggttttagagagtctagtcgcgttattacaacacggtgtgatcctcaaggagacagacgtggtcagtgcgacgaaaatggcgctcaaagggacgttaaatcaatttgaggccctttatactgaaccactcatcaatgaccgcaagggtcaaccaattcgtgttaagacgtttggacaacggcaatatatcgatgcaattcgccacaatgatgtgacgtttgggattgggcctgccggaaccggtaaaacgttcttagcagtcgttatggcgattgctgctttgaaaaaaggaacggttgaacgcattattttaacacgcccagctgttgaagctggtgaaagtctcggctttttaccaggtgatctaaaagaaaaggttgatccttatttacggcccatttacgacgcgctttatgcggtgttgggtaaggaacatacggaacgactaatggatcgtggggtcattgaaattgcgccacttgcgtatatgcggggccggacgctggaagaagctttcgttattttagatgaggcccaaaatacgacacctgctcagatgaagatgtttttaacgcgattaggttttaattctaaaatgattgttaatggcgatatcagccaaattgatttacctaataaaacccagagtgggttagtacaagcggaacaaattttgcgcgacattcctaaaattagctttgtgcaatttagtgcggaagatgttgttcggcacccagttgtcgcgagaattattaatgcctatgcggcaatggataagacgagaaagtagatggatattcaaatcatcgatgaaacaaaaattgtaccagaagcacaaattaaattggtggaagatgtattagagtttgctggtcaaaagcttgaattagctgaagatacagaaatgtcagtaacatttgtaaccaacgaacgtattcgccaaattaatcaagaataccgtaatacggatcgtgcgactgatgttatcagttttgcaattgaagaggatcctgaagaagaaggcttacctgccaactttgaagaattgtttgatattcctaagaatattggcgacctatttgtttcattagaaaaagccgctgaacaagcagaaacttacggacattcatttgaacgtgaattagggtatacgatggttcatggtttccttcatttgaatggctatgaccacatccacaccgaagatgaagttaaaatgattcctttacaggagactatcttagatgaattcggactcaaacgctaaatgaattcggactcaaacgctaaaaagacgcagacggataaaaatcgtaattttaatcaatcgacacatcacgctttagatgggattatcaccgcttttaaggaagaagctaatctgagacgtgatttcgtgattgcgatggtcgtgctagtagccggttattttgcccgattacactatctagattggctatttttgattttagcgatttttatggtgttgttggctgaattttggaataccgtgatggaacactttgtcgacttattggttgatcggcagtttcatccactggcgaagaagattaaggatatcagcgctggtagtgttttaattggcgcgtgtttagccgtgattatcggttgtgtcgtttttggacacgcgatgctttattatttttaaatgtcagatacttatcgctcaggctttgtggccattgttggccgaccaaacgttgggaaatcaacatttatgaatcgaatgatcggtgaaaaaatcgccatcatgtcatcaaaggcacaaacaactcggaacaagattcaagggatttatacagatgacaacgcacaaatcgtgttcgttgatacacctgggatccataaaccacataacgaattagacgaatacatggatcaagcagctctttcaacatttaatgaagtcgatgcgattttattcatgattagtggcgttgataagaagggccctggggatcaatacatcatggaccaacttaagaatgttaaaaagcctgtttatttggttgttaacaaaattgatgccattcacccagacgatttattaccaatgatcgaacaatatcgtcatgaattggacttcaaggctgtttacccaatttcagcattggaaggcaataacgtgcccgaaatgttaaaagaacttgaattaacattgccagaaggcccacaatactatcctgaagatcaattaacagatcacccagaatatttcgttgttggtgaattaatccgcgaaaaaattcttgaattaacccacgaagaagtgccacattcagtagccgttgtggtcgaacgaatgaaagaccgcgtcaatggtaaacttcaaattgaagccaacatcattgttgaacgtgatggtcaaaaacggattattatcggtcaaaaaggctcaattatcaaagaaatcgggattcgttcacgtcgcgaaatcgaagctcttttaggcgaaaaggttaacttgaagctttgggtcaagattcaaaagaactggcgtgataataaccaatatctccgtgaatttggttacaataaaaagagattgtagatggcggaacatcgatttgaagactttaacggtctagtgatgtatcgaaagaattataaagaaaaagatatgttggttaagattttaaccgatcgttttggtaaaaagatgttttacttgcgtggggccaataagcctaaatttcgtctaagtgcggctattttgccgtttacgcaggccgaatatggcggcgatattcgcgatgatggcttatcatttttgaataatgtgaagtcagccacgcaatttcaaacgatcagtcaggatttatttttaaatgcttatgcgacttatatcctgaacttaattgatgtcggctttccggacagtgaaccattaggcatctggtatgataaggttgaacaggcgttaaatctgattgatgaaggttttgatgcggcgatgattacccatattatcgaaattcaattactacaggtgtttggtgtgcagccgcaattacaaggatgtgccgtttgtggccgaaccgatttagcgtttgattactctgagagttatggggggcttttgtgccaacgtcattggcatttagatcccaatcgtttccacagtagtcagcgggcaatctattatctccgattgttttccgtgattgatctgtttaagattcaatcggtgaacgtgaaggaagccactcaggtcgaactcaaaatgattattgaccgactctatcaagatactgtgggcctgtcattgaagagtaagcaattcatcgacaagatgtacagttttgatagtcaattaccacaattaaaaaaagtgccgtcagaaattgacagcacaccaaaagacgactaaatggttaaaaagttgaatgttcaagaaatgattttaaccttacagcgtttttggtctgaaaaaggctgtatgttgatgcaatcttatgatacagaaaaaggggccggcacaatgagcccttacacgttcttacgggcaattggaccagaaccttggaacgccgcttacgtggaaccttcacggcgtccagcagatggccgttatggtgaaaaccctaaccgtttattccaacatcaccaattccaagtgatcatgaaaccagcacctttaaatattcaagaattttatttggatagtttacgggccttaggaatcgatcctttagaacatgatatccgttttgttgaagataactgggaaaacccatcaatgggctgtgccggtgttggttgggaagtttggttagacggaatggaagtcacacaattcacatacttccaacaagttggtggtttgcaatgtgaccctgtcacgagcgaaatcacatacggtgttgaacgtctcgcttcttacattcaagatgttgataatgtttttgatcttgaatggggtaacggcgttttatatggtgatattttcaaagaaccagaatatgaacactcaaaatacgcctttgaagatagtaatcaagaaatgcttttgaaattctttgatgaatacgaaacagaggccaaacgtttaatcgatttaggtcttgttcacccagcttacgattacgtcttgaaatgtagccatacctttaacttattggatgcacacggtgctgtttccgttacagaacgggccggctacttgtcacgcattcggcggatggcacattcaatcgcgcaagcattcgtcgctgaacgtgaaaaacgcggattcccactattaaaacatgcacaagaagcaaaaacggaggtcgtagatcatgactaaatgactaaaccattcttattagaaattggcttggaagaaatgccagcccacgttgtgatgccaagtatccaacaattagaaaaacgggtgcgtgacttcttagaagaacaacatcttgaatttggtcaattaaaaacttatgccacaccacggcgtcttgcaatcttgattgaagacttagctgacaaacaagctgatattcatgaagaagcaaagggccctgctaaaaagattgccctcgatgctgaaggtaactggagtaaagcagcccaaggtttcgttcggggtcaaggcttaacaacagatgacattacttttaaagaattaaaaggcgttgaatacgtctatgttgaaaaatcaattatcggcaaacccgttgaagccattttaccggagttaaaagctgtcattatggcgatgaccttcccaacacggatgcactgggctgattacgatttcgaatatattcgcccaattcactggattattgcgctattagatgatgaagttatcgactttagtattctaaacgtcacaactggccgcacaacgcaagggcaccgtttcttaggccaagaagtgactttggctaaagcaaccgactatgaagctgcccttgaagcccaattcgtgattgctgatgaagctaaacgccaaaacttaattcaaacgcaaattgaaaaaatggcgcaagaaaatgactggcaagttgatttagacgctaacttgttagaagaagtgacgaacttagttgaatggccaaccgctttttacggtcaatttgatgctaaataccttgaaattccagaagaagtgctcattacttcaatgaaggataaccaacgttacttctatgcacggagccaagctggtgatttattaccagtctttatcggcgttcgtaatgggaacgacgctttcatggaaaacgtgattgctgggaacgaaaaagtccttacagcacgtttagaagatgctgatttcttctaccatgaagatcaaaaagtaaccatcgctgaaaacgtcgctaagttacaaaacgtttctttccacgataaaattgggagccttgctgaaaagatgacccgtgttggtttaatcgctcaattcttaggtcaaaaattcggtttatctgaagctgaattagttgatttacaacgtgctagcgacatctataaattcgatttagtaaccggcatggtcggcgaattttctgaattacaaggtgtgatgggtgaaaaatacgcgctattacaaggcgaaacacctgctgttgcgactgctgttcgtgaacattacatgccaatcagtgcagaaggcgccttacctgcaacgaaagtcggtgctgttttagcaattgctgataagtttgatagtatggctgatttcttcgctgttgggatgattccaagcggttcaaatgatccatacgcattgcgtcgtcaagcttacgggattgtccggatcttagaaaaccaagactggcacttcccaatggctgatttccaagcagctatgagcgatatcgttaaacaacaagccgatttcgatctagattggtcagccaatgcagctgccattagcgatttcttaacagatcgtgttcgtcaacgctttaacgggatgcgtcctaaggttcgtcgggatatcgtcgacgctgtcttgaaaaaccaagcgcaagacccagttgtgatgtttgaagccgctaaagtgctctcagcacatcaagatgatgctgatttcaaggcaacaattgaagctatcacgcgtgtcttacgtttagctgaaaaagttgactttgaaacaactgatttaacggttgatccagcgttatttgaaaacgatgctgaaaaagcactttatacagcagtcgaagacttacgtggcgcaacagcgacaaatacgttagctgaaaattatgccgcgttacaaacactacgaccattaattgaagcttacttcgatgccacaatggtaatggctgaagatgaagccgttcgtcgtaatcgtttgacacaactcatgattatcgctcaaatcgcgcttagcttaggcgatttaaacgaattgattgttaaataaatgttacaaatgaaacgggtttatgaagcagccgccgattctgacggttatcggatcttggttgatcgaatttggccacgggggatttcaaaagaacgcgccgaaattgagacgtgggctaaagaaattacacccaccactgacttacggaagtggtttggtcatgaaccagctaagtttcccgtttttaaagaaaagtatcttgctgaaattgctaccaacccggattggccagaattctgtcacttagtgcagcatcaattagcgcttggtgatgtgacgctcgtctatgcggctaaagatccgcaatataaccatgttgtgattttaatggcacttttaaaaaagacgcttgacaagtaaatggcgggtaagattccgaacgaagtcatcgatgagattcggagccagactaatattgttgatgttgttggtcaatacgttcaactcaagaaagccggcaagaacttatttggtgtttgtccttttcatgatgagaagacaccatcattttctgtgagtgaagagaaacagattttccattgtttttcttgcggtcgcggggggaacgtcttcaagttcttgatggaattggaacaaattagttttccagaagcactgacgaaagtcgcagattttgctggagtgacattggcagatagttataagccaactgctgttcatcgcgaatcaagcgaggttacgcagtttaagcaactctatcaacaagccaacgaactgtttaagcatattttaactagtacggtggctgggcaaccagcgcttgattatttacacgaacgacagatgaccgatgcgttaattgagacctttagtattggttatttaccggatcaatcggatctattgttgacgtttttccagaataaggatattccttatcaggtattgcgccaatccggattgtttattgaaacacaaacgggtaagttacacgatcgtttttctgggcgggtaatgttcccaattcgaaatgcgcagggtgaggtcatcgccttttctgggcgggttttaaccaaacagccggatcaaccaaaatatttaaatagccctgaaaccgtgatttttaataagcggaaagtactgtttaactatgatttggctaaacaaaccattcatcaatccaaaaaagtttatctttttgaaggctttatggatgtgattgcggcctattcggcggatgtcgtcaacggtgtcgcgtcaatggggacgagtttgaccaccgagcagttgaacctattggcacaacaagcgcaggaattagtggtgtgttatgatggggatcaacccgggattgaagcgatgaaacgggcgattaacctattgcaacagcatacgacacttgaattgagcgtcgtggtcttaccaggcggcgttgatccggatgagtatgtccgtcaatatggtggtccgcaatttaaggaaaccttgcaaaatggaacggaaacgcccattgcgtttgaactacgttacttgaaacaaggtttaaacctcgataacgagaaggaccagcttgattacgtacaacaagcattagaagttgtggcgcgtgttgagtcgcctttagcaatcgaagtttacttgaaacaggtcgaagccgatagcgggattacgctggatacattgaagcggcagttacaaacggtgcgggttaaacatgccacgcaagttcccatcaatcaggtgggacaaccggaagcaccgccatactttgatgattttcaggcaccaccgctaccaccagaagaaacggctggagcttttggcgatccacggacgattgcacccaagcggcagcctaaacggttaacgcggattgagcatgctgagcaagaaattttgcacatgctgattcataacgaagatgtgcgtttacaactcgaaaataatgccgattttagcttcgtgcataccccgtatcaactcttatacgagttatggcggtccttcatcgcagaagggcagccggctgatatagcgggtttcacgagttatattccagatgacttgcaggaactagtcgttcagattgatcttcttgatttacctgaagaggctaatcaagaagcgttgaacgattgtttggcggtcatcgggcaaaattcgattcaggaacgtttaaaagaagcaaaaatcgccttaaaagaggcaactaaattaggtaatcatagtgaggaactacggttaactaatgaagtgatacaacttgtttcgcaaatgaaatgaatggctgacaataaaaaagctgatacgaagaaattagacactgcggttaaggccttaattaaggaatacaaacccaaaaaagaaatcaccaatgatgaattagtggcaaaaatcgttaaaccatttgcacttgaagcagatgaaatcaacgaattaatgcaacaagtggaagatcacgggattgggatcgtcgatgaagacgggaatccaagtgctgccacattaaaaaaagaaaaagtttctgctaaagaattaaaagatatgtctgcaccaactgggatcaaaatcaatgatcctgttcggatgtatcttaaggaaatcggacgtgtttctcttttaaatgcgcaacaagaagttgacttggccttgagaatcgaacaaggtgatcaagaagctaaacaacgtcttgccgaagctaacttacgtttggtggtctcaatcgctaaacggtacgtcggccgtggcatgcaattcttggatttaatccaagaagggaacatgggcttaatgaaggctgttgaaaaatttgatcatcgtaaagggttcaagttctcaacttacgccacatggtggattcgtcaagcgattacgcgtgcgattgccgatcaagctcggacaattcggattccagttcacatggttgaaacgattaacaagttaatccggattcaacgtcaattactccaagatttagggcgcgaaccaacgcctgaagaaattggggctgaaatggatatgaacacggataaagttcgtgaaatcttgaagattgctcaagaaccagtttcccttgaaaccccaatcggtgaagaggacgactcacacttaggcgattttatcgaagatcaagatgcaactagtcctgaagaacatgcttcttatgaattgttgaaagaacaattagaaagtgtcctagacaccttaacagatcgtgaagaaaacgtcttacgtttacgtttcggtcttgatgatggtcggacacggacgttagaagaagtgggtaaagtattcggtgtaacccgcgaacggattcgtcaaatcgaagccaaagcattgcggaaactacgccacccatcgcgttcaaaacaattaaaagatttcttagaataactaaagattgaaaatgccccataacccaaagccaatcatcatgagtgccattaagccccctgagtacagggcaattggcatgaagtacgaaacgttgcgattggcctctgtttttaaatacttgaaagtatttaaagttgcgtaaacctgatagagaccgagcattaaaaggacaacacttaagaagatagacatttgtcaccaattaatttatcgaaacgtttagctgcagttgcgcagttcgtcccacaagatagcatcgttgctgatatcggctcagatcatgcttatttaccaatctggctcacagagcaaaaacgattaaagggggccatcgcgggtgaagtggttgctggaccttttgaatcaacccaaacacatgtgatccaatggcacttagaggaccaaattcaagtccggttaggtgatggtgtcgaagtgcttaaccccgaagaagaccaagtcacctgtattgtgattgcggggatgggtggtctattgattactgaaatattggaacgtggcttagcacatctaaacgggcacgaacgattagtcctacaacctaatattatggaacccaccgtccgggaatggttaatgaagcaccactacgccattgtagaagaagcaatcgttgctgaagacggtcatatttacgaagtcatcgttggtgaaccaagaactgaggctgttgaactcgacgaagctgacttagtattcggcccagttttacgacgctgtcaaccggcagatttccaattgaaatggtcaactttattaaataagaaacgtcatttattggtgcaacttcaaggtgctcaggtcacgccaactgaaaaaattgctacagtgcaacatgaaattcaattaattgaggaggttcaaacatgggacaattaaatgggacaattaatcgcgagtgacttgattgcggcgattgaagagtatgcgccattagcgcttagagagggtaatgatccaacaggttttcaaattggtcgccgtgataaggtggttaagaaagtactcgtcacattagatgttcggccggaagtggtccaagaagcgattgataacgagatcgattttatttttgcccaccacccagtgatgttccgacctgcacgcaatcttgatctaagtgatccgcaaaataagatgtacgctgatatactgacgcatgatatgacggtctatgcagcccataccaatctcgataaggcgcaaggtgggatgaatgattggttggcagcagcgttagcacttaaaaatgtgcaaccgttcaacgtgactgattatgaagcattaatgaaattggctgttttcgtacctgaaacacatgcggatgtggtacgccaagcgttagggcaagctggtgccggtgaattaggaaactatcaaaactgcagttttagcgctgaaggcaccggtcgttttgaaccgcaagctgcggctgatccgtttattggacaagcgggtcaggcagaagcggttgctgaagttaaaatagaggttattttaccagcagctaaaaagaaccgcgtgttaaaagcgatgcttgctgtacatccttacgaagaaccagcgtatgatttaatcccattggctaatcaacaacaacctatcgggatcgggcgcattggtcaagttgatcaaccaatgacagtccgggactacgcccaatttgtttgcgaaacgtttgatttaaccggtctccgcttgatttcaaatgaacctgataaattagttgaaacagttgcagtagttggcggtgatggtggtaagttcttccccgctgctctgcaagccaaggctgatttgtatattactggtgacgtttattatcatacgggtcatgacatgttagcggccggattatccgttatcgatcctggtcatcatattgaaagcattgtgaagactaagatgactgcgttatttgaagaatggcgtcaaataaacgattggcaagttacttttattaaatctcagcaaaaaactgatccgtttacatttatttttaatgcgaagtagatggctaaatatgaaaaattaattccgcgttttctagaatatatcacaacagaaactcgttcagacgaaaatgcgacgacgattccatcaacacaaacacaagtggttttcttacacaaattgatggatgacttgaaagaaatcggcttaagcgacgttaagtataacgaaaaaaacggctatgttacagcgttattaccaagtaatatcgataaaaaagtgccaacaatgggctttttatctcacgttgatacagcagatttcaatgccaagggtgttaatccccaaacaattgaaaattatgatggcgaatcaattatcaaattagacgaagctggtcaatttgttttagatcctaaagaattccctaacatgaaaaactataagggccaaacattaattacaacagacggctcaacattattaggttcagatgataaatctggggttgctgaaattatcacagcgatggattacttcatccaacatcctgaaatcaaacatggcgacatcaagattggtttaggaccagatgaagaaatcggcacaggtgctgatcacttcgacgctgaagattttgcaacagacttcgcttatacaatggatggcggcccaattggtcaacttgaatatgaaacatttaatgcagctgcaatgaaagttgatattcaaggtaaaaacgtgcatcctagtgaagctaaagacatcatgattaacgctttacaagttgctgttgatttccaagatgctttcccacgcgatgaagtacctgaaaaaacagatggccgtcaaggtttctatcacttattgagcttagacggtactgttgatgaagcacacatggcctatatcatccgtgattttgatcgcgatggtttagaaacacgtaaagcatttgctgctaaagtggctgaagacatgaatgctaaatacggtgaaggtcgcgttaaagcaaccattaaagatcaatattacaacatggcagaagtcttaaaagatcatatggatgttgttgatttggctaaggacgctatggaagcaatcgatatcaaaccattaatcgaacccgttcgtggtgggacagatggttctaagatttcattcatgggaattccaacaccaaatatctttgccggtgctgaaaatatgcatggtcgctacgaattcgtttcagttcaaacgatggaaaaagcggtcgatacaatgattaagatgaacgaattaaacgttgaaagaaactaattaagcttgattagttgtcagtaaaccttttagttgctcaattggtagttggccgggcgcgctaggtgtttcgagatagccaaaactgataactgagccaaattgaccgccaaagattcgcgaggcgacaccaaattcagacattgccattgtcgtcaatggtttatcgaattgatgcgtaaaactttgagtggctgctaacaagcgggttgtatctgctggtgattgggccgtcgtcgctaatttcaagaggtccgcatcagggtcggcttgcatggctaataattgcgtgcgcaaggtatcattatccggtgtttgaacggtatcatgatgactcaaaagcacttggtaatgctgttgatgggctaattcagccaattgatgacgttgctcggctgctagtgaccactctaaatcgattgcttgaccaatatgggctttgatcaagggagcgtagtaggtgaggtagtcttgagctgatgctaagccaccatcgttagtggttctaaccgttaaaattaagggcaaatcaagcgcggctattttttcagcagcggtcaatagttgtgcaggagcttgccaataatcaaggcgccattcgagaatatcgatggcgtcttttttttgattgatgaggattagttcgtgcaaacagtcgtccaaatggcgtggcattagggaaactgccgtttgggtttgaccggtagtaaactcgaggtgcatttaaagagattgatcgatatggttgacgagatattgtccgtcaacctgtttgaattcccagatttcgctgaaacgttcgatataagttgcttcacggcgtttttcattatcttcgtctgatgagcggtcattagtgaaataatcgcgcatttgggccgttacaaggactttacggacgtttggattgtccgataggatcagttcctctgagatgatggtcagactttccagctgattatgtttatgttggcgttgataacgatttaaaatacgttgttgctgccgttggaaatgaggggtcatgagcggtgcgaccaaactaagatcattggtggtccaagcagcttcgatttggtaaaagcattcttcaaaacgttcgcgggttgcatcgtcaatcgtgacggttcgtgatagagcccgttcgtgacgccgcgctagccagtcgcgtttcttgcggataatcattaagaaggctgatatgataaaaaagattgcaaaaacgaggttgttgagaaaactacggggcccgtagtaaccccggcgaccgtaataattgttcgttgttctgtcggtggtcgtacttgtgctgcctccaaacgaaccactagaggttgaaccaccgccaccacctgaagccccaccggctcttgcataggtagcagttggcgctagacaaatgagacttaataataaaatgaaaccaatgattaattttttcatttaacgatgagcaatatcgatttctgccaaccaagttagcgcaagcgggagccactgggcaaccggttcattaacgtcttgtggtttaccgggacgctgggttactttattggccaatgccaaaccgtgaacaccatcactgaataagtgatactcagttgtgatgtttaaccgatttagttcagtgacgtacagtaatgaattgatggctggtacgagttcatcagttgccgtttgccatacgaaacacggtttggcccattttgttaatgtgtcctgtgcgtgccagagacgttgatcagttgtaatccgctctttttcactttcttctttaggaaaaccagcgtctaaatcaatgacaggatagctcaattaatattgtgtgttcagttcagggttagtagcgataccgttaaaagtagccactagatgcccaccagctgagaaaccaacgagtacgattcgttcgggatcaaccttttgcacttctgattgatctgtaatccactcgatcgttttagcgagctgttggagtgctgtaggataaaccatttggtttggttcgatgagttgataaggtaagacaactgcatggcagccttcagctaatgcctttaagacaattggttctgtttcacgctgtgaatggtagcgaaaaccacctcctgggcagataatcacgaccggttgatagcgagtgttgttaaaatcttgattggaatctagccagtaggctgtaacttgaaagtcctggtgattcgttgtgagcgtttgattcataatttgcatatgatatcaggttatacagcactttatggcttgattgcgcacccagcgcaacatagcttatcaccctttattcacaatactggttttcaccaaattcaaatggatgcgcgctatgccgtcttcgatagtcaggcaacaccggcagcaatcgccagcgcaattaaggcgctaggtattcggggcgttaatctatcgatgccttataagcaatcacttgtcccgctagtggacgacttaacgccaacggctaaattagtgggggccattaataccattaaaaatgaggctggccatttaacagcaaccaatacggatggtgatggtttttggcgtgccttacaaaaagcacatccccaacgcagatatcgttctgttgttattctaggtgctggtggggcggcactagcggtaattgaggctgccgtgcggtatggtgtgcagcagatgaccgtttttaaacgtgctaatgcgacttatgattcagtcattcaacgattggctcaaattagcgttgctagtggtctacagattactgttgaaccgtacgatgaccagttagcattggcaactgccttgcaaaatgctgattgtttaattaatgcaaccaatattggcatggccgcaacgccgggtaatcccttaccaattaacttactgcaatatttgcccgaagatagccttgtcgcagatctaatttacgcaccgcgagagactgcgtttttaaaagcagctcaaaaagcgcatttaaaaacgcaaaatggcctgggcatgctgattgaacaagcggccttgagttttgaattctggaccaacgaatcaatggcgacaacgccaatttaccaacatctaaatggaggcaatgatgcatcatgaatgattattcaatttaaagcaacaacgagcaaatcactcatccaagatttttgtgaacgacaacgccaagctggtgtcgtggtttaccaatcagcacaacacgtcgcattaattggacttaaggaagtgacattaactgctgcagaacaagcaggcgtcgattcaatgacaactgatgaaccaagttatgttttaagtagtcgattattccaacctgaaaatacaatcattcaattaccacacagtacaattggtggcgagcagtttacgatgatggccgggccatgttcggtagaatcagctgagcatattttagcgatggctaaagtggccaaggaagggggcgcaactttactgcgtggtggcgcctataagccacggacttcaccttactcattccaaggaatgggtgaagctgggctcaaagcactccgccaagcagccgatgcaacaggcatggatgtcattacggaggtcatggatgaaacgcatgtggccctaattgcacaatacacagatgtcttccaaattggggctcggaatatgcaaaacttttcattgttaaaggccgttgggcagacgaacattccggttgctttaaaacgtggtctagccgctacagttgatgatctattaaatgctgctgagtatattgcagccaacggtaatcgccaaatcatgctcttagaacgcggaattcggacttttgataatcaatatacccgcaatacgtttgatttaaacgcggttcctgtccttcaaaaattatcacactacccagtgatcgttgatccaagtcatgcgacgggggaatgggacttggtgacaccgatggctagagccggcgtagcaactggtgccagcgggatgatggtggagattcatgaccatcctgaagtcgccttttccgatgggccacaagcgttgaaacccgcgacttatttagaaatgtgtcgtcagatctgggcgattgatcaattgatgcggtcgtggtaaatgccaactatttcggttaatttaacgacgcaagaatatcaaattaaaattgaaaatggcttagcgacttcaatcgggcgcgaagttcaacaggtgtggtctgcacgtaaaattgcattggtcacagatacgattgtcggccctttgtatcaagcacaagttgctgcgcaattaacgcaagctggttttcaggtcactgtccttaccgtcccggcaggcgaatccgctaagtctctcgaacaagcgatgagcctctatgaggcattggtgacggccaactttaatcgcagtgatggtctgattgctctcggtggcggcgttgttggggatttaacgggttttgttgcctcaacttatatgcggggtttaccgtttattcaaattcccacttccttattagcgcaagtggatagcagcgttggcggtaaaacggctgttgatttaccagcgggaaaaaatttagtcgggactttttatcaacctgagctcgttttaattgatccgcaaatgctcgagacactaccgcaacggcagttaatcactggttacgctgaagtgatcaaagtagcggcattagtcggtgccgatttttggaacctcgttcaacaaatcgaatcgccgactgcaattttggataaagcaccagagctgattacgcgtagtattgcctataaagcacagattgtgatggcggatgtccaagagagtggtcaacggcggttgttgaatttcggccatacaattggccatgctgttgagtctttggcagatggtgagttaacgcatggcgaagcggttagtatcggactagtcgcaattagtcggcttttcgaacaaccgactcaaattgcggcacaactgcaaactgttcttgaacgggttggcttaccggtcacgcacccgttattacaatcacccgcattatttgagaaaattgcgcatgacaagaagaatcaaggcgctctgattaacattgtttatttaaaagcgatcgggcagccaactattttacaactaccattaacacaatttagtgcccaattaaaaatgaaacagcgctcgttttagatgcagttaattttaattgggtttatgggttctggtaaaacaaccattgcacgtaaagtcgcacatcatttcaagagcgaatggattgatttggacaaatacatcatgcgggaacagcagatgacgattaacgaaatttttgccattaaaggccaatctgcgtttcggcagatggaatttgaagcacttgcaaaattggttcaagaagatgtcgtcattgcgaccggtggtggtgtggttgatgatgcacagacgcgctatctactggaacaaagtggcatccccatcttttacttaaatgggagttatgaggcgcattggcgccgcgtttcgcgtaatgatcgccgaccactggtcaatcaacttggtcatgatggtttacgggagttatatcacgaacgacgccctaaatattatcgtttggcagactacacgattttctttcagcataaaacaccaaatatgatgttgacggaaattgaaggacaactgccacgtattcaaaaaaaactggctaagcgacatacttagatgacttttaaattaccagcattaccgtatgagtatgttgctttagaaccctatatcgactccgaaacaatgcatcttcatcatgataagcatcataagacttatgtgacgaagttaaacgcagccttggcaaaacaccccgacttagctagcaaatcattacacgacttactaacacacattgatgatcttcctgagtcattacagacaccgattcgcaataacgcagggggtcacgctaatcatagctttttctggcgaattttgactgaaaatgccccactgatgccaacaggtgaattattagaaaaaattgaagcacgttttggcacctttaaagattttcaagctgaattcaataatgccgcactgggtgtttttggttccggttgggcatggttagtcgttgatcacgacggcaaattgcaaatcatgacgacccctaatcaagattcaccaatcatgagtggtaatcgcccattgattggtttcgatgtttgggaacatgcttattacttgaaataccagaataatcgcattgactatatcgagaatttctggaaaataattaattggccgcttgtggcggaattaatctaaatggcacaaacaatatcaagtcaaatgctgaaagggattttacaaggaatcatactaatgattcttgataaaggaccagaatacggctacggtttaagcaaaaaaatgaatcattatggccttgaaaacgtacctaaagggactatttatccgttgcttacgaccatcgaaaaacgggggttgctagtcagcaaaattaaaaagtcggatgaagggccagatagaaaatactattttattacggcagaagggcagattgctaaaaaggaatttattaatgagtggggccagttacaaactacggttcttaaattaatcgaagaggagtcgcaaatatgaatgacaaagattaaggcgttaattcaaaagaataaccaactaaggttagcgttaaatactgaaaatagacagttttataatgatttattactatacatgcgatgtcaatcaattacacgaaacgaagaaatagttgaaaaacaattattagtaattcttgaagatattttggacgcgcaacaagatcacattagtgctgaaacttattttggaaaaaatgtcaaaacgattgctgacgaattgatggtggagataccacgtaattttttggggatgatgcgttttttattattgggaatgggagcatacataattgcattttcattacctagtttgctaagtcatgatgtctattttgatatcgggacaatcttattagctgcaagttattttgttgtactaatcgggttactttttagaaatataggcaatactatttacacagctaaaataaactatacaaagcggattatgcgctggtcgatttggacagtaggttttgctggtggtattctaatttcgatattagttaaaacaccgctgcaaataaaattttctggatggttagtgcttagcgcgctaacgattttagtgatagcatatctattactaaaaaatagacagcaaaatcatcattaattagagattactatccgttgtaaagttcaatggtgagaggtttgcactgtccgtaatgagcttaacagtgaggcgttccatttcgtgttgcgcaagttgggctgctttagcagaacctttggtcatcaacatcgttcgttggtgcgcatcggtttcagctgcaacaagcttgtcagtagcaacgatattttgcaccatcaaactgttgatgtgtttttgtgtttgttctaagtctttagcgaatttagcgtagtgggcatcgactagaataccagctaatttataggtccaatagatggaatcctttgaataatcttttgtacctttttggtagttaactgggacatcatcagcaccggcgtaaaatggcacgtagacgctctgtgcagtcacacccatcgctaaccagtggataccgctgacatcaacagggcggttaggacgcatttgaagaatgtgtgactcttgtgttttcgctaaactaattgggcggaaagcatgtttttcttgtggtgtgccgtgaccaattggatcgtagacggtcccttcatagtgcgagcctaaaatctgagcgacatcttcgacttgaataggtgcatcaggttggcgtaagaagggcaggttaaagtcttgtggttgttgttcaacagacggtgttaaaagcttttgaccgtaccaaacacgtggtgtgttgtaaacgaggtcgctttgatcttgtgtcccaaagatgttgcggaaattaaacggtgtgccagcttgccagaggtggttatcacgggcaaagttttgaagcccctcagaagtcataaaggcctctggttgatcaaaatcaacttcttgaatggccagttggttggccacgacagcgtaactgtcatcaggaattcgttgcgcgacccagtgatgaccactaccaatttctaggtaccaaacttcatcaacgtctgaaaaaagaataccgttactttcggttgtgccgtattcactgacaatcgcgcctaaacgagcaaccccttcgcgggcagttttcacgtatggtaaaacaacagtgatcattgcttcttcagcaatgccgttatcgatgtagggatcgaagccgagtacgcgactattgctatacgcactttcggtcccactcatagccacgccgtattcattgataccatcttcttcgaataagccgtattcatcggtccattctggggttgcggtatatttagcggcttctagtggtagatcaagcgtaaagccggtgtcttttgaaacaaagtgaggtgctttcgttaattgttggtggggatgaatcaccatgtgtttaggccaagcagcttggctatcttcgtttcgtgcgattaaggtcgagccatctgcgctcgcttttttaccgaccagaacactggtacaggcggttaattgacgataaaggggttcactcatatgccattagtacacatcgatcttattgctggtcgtagtcaagcacaattaaaacaactttgtgctgacgtgacagaagcaatctcaaaaaatacaggggcacctgcagaacacgtgcatgttgtcttaaatgaaatgcaaccagaccgttactcagtaggcggcgttttaaaaagcgacgaaaaatagttagtccatcttaaaatattgacgtaaataattcgctacaccgtcttgtgcgttggttagtggggtaatatcatccgcgattgccttaactggtgcaattgcattttgcatcgcgaccccggtaccggcataggccaacatgtctaagtcattactttcatcaccaaaggcgataatgtcggcttggtcaatttggtaatgatttgctaagcgttcaagaccagttgccttttgaataccgtggtgcacgatttctaagacgcttgctgggccaccccacgtattaacggaaacttgggggaattggcgtaaaatttcagctcgcaaagcagcttggtcctcgcgttcgacgaagactgttacagctgctggatcttgttgaagtgatttacgcgttagaatttcatctgatttgagcgttgcggggaaaaacgaaaaagtattgctgtaagcttgatcagctaaaaacattgttttcccttcagcggcaatcatctgaattttaaaacgttcttttaattggaagagactaaaaacgacgtccttattaatggtgtattgatattcgtcggaccaattttgcccaggaatatgcatgagggcgccgttaaaattgaccatcggtgacgtgagccctaattgatggtagaaaggttcactcaagcgattaggccgaccagtcacaatactgacaatatggccagctgattgtagttgggtgagtgtttcttgtgttttaagtgaaattttggcttctggatttaaagtcgtgccatccaggtctaaggcgattaatttttggttcatatggcagatgaagaaatgaacacgcaacaagacgattcagcaatcgaagatttaaaggaacggattttagcagcgctagaaaccgtgattgatcctgaattggggattgatattgttaatctaggacttgtctacggccttaacctagatgaaaagggcctatgtacaatcgatatgacgttgacgacgatgggctgtcctttaacagatgtcttaacggattcaattcatcaagcacttgcaaaagtcccagaggttaaagatgtgaacgttaatcttgtttggtatccagcctgggacaccagtaagatgtcacggtatgcacgaattgccttagggattcgttaaatgacccaagaaacctatttggcacagttaaagcaaagtgcagtctttttcaaaaacgtaccgcaactaacagcgcaatttcaagcgatcaaagcaagtttagcacgtctacaacaaaaacagttaccacagcacaatctcccagtactcgggattgacgaatcactctatctaacgttattattggcagcagagcagggtcaattcaaggcggtctcttcacagcgattacaagcgcaaattaaaaagacggatcatttactccgcaattatcggcaatatttgcaaaatcaattcggcatgtgggcttatattagtcaggatttgacggatagtatcgtccaacagtttcccgattggcgctttttggaaattatggctggtaatggctacctgagtgccggtttaagggcggcaggtgccgaatcggtcatttgtacggatagtttggcctggacgagcgaaaaccagacagggcggcaattattgacgcaggtggcacctctcgatgcacaggcggcgctcaaacaatatggtgatcaagtggatgccgtattgatgtcgtggtcgcccaacggtgtgccgattgatttagccgttttaaaccaattacggcaattagaaaacgggcccgtccttttatgcttgggtgagcgctacggtgccacaaatagtactgaattctgggatgccgctcatttccataatgatcaacgcttatcgcgggttaatcgctatttacgcccgtttgatttaatgcgtgatcggttttactggattcaataattgcgtttaaaaaaattagtgcttgatgttctatttgtcggggtggtcgtcttaggcctcctcgtcatcagtcagcgagctaaatcgatgtacagtgaacgacttaatcataatagtttatcgcaaaaggcggttatctttaagacgaagagtcaccaatcgattcaatcaacgatccaagcgattgacaagaccaaactcaataatttccaagtgcaattcaatgtcaataatcatttatcctatgtttatgctaaaggtaagcaagctaatgtgccgctcaaggacggtcgtttcttctcaaattatgattttaaatcacgaattccggtggtggtcgtcggacaatcccgggtcaacgaactctatcaaccagctagccaggcttattatcagactaagaatcgttacttgtcagtaattggggttgtgggtaccaatcagacaacttcgcttgaccaacacgtctttatttcggcttcaccagagttcgtcttgaacaaccgctcgctaaaccaggtaacggtgttagtcgatgatcaacaaatcggggcgcatcttaaagaatatcaaaagatctttaagaccaaatcaatctccaatttaacgcctaagaacacgccgattattggggtcaactggttgcgagaaaatgggacggcagcgatcatcctggtcttgctaatcatagttgctggggtgcttagtcatttatttgcgcaattggtcaatggctatcacgctcaaaagaatttgaccgctagcctttaccgtaaatatagtatgggacaaacgcagatttttgcagcacatctcttaagcatgacactgatcggttttattatcggtagttggttcttctacttaacacacttgggtattattttcggtgggttagtggtagttgatctggttttaattgcttatttctactttagaatgacgcgcattaaatcagcgcactaattaaagtgataaatgtcgttcgtttaaataatgtcgtaaattagggcttaagatcatgggtgctgattgaagtgctgttaggtttcttgcacccaacatcgccatgattgactggatttgagcttgccaagccaataattgttcagcagtttcagtaggccccgttttgatcagcatgtgtaaaatctgacctgaaatcccaacagcagaagcgccaagacgtaatgctttgacgatatcaagcgggttacgaatcccaccagacgccaaaattgttaattcattttggaaggcttgtgattcgaagagtgattcaaccgttgattgcccccaatcactgaggtagtcgtaggctttatctcggcggcgttcattttcaattgtgacgaagttggtgccacctttaccggaaacatcaatattggtaacgccgacactttgcaatttagcaattgtttcggcgctcatcccaaaaccaacttccttaacgatcacagggacgtctaagttggcgacgatttcgccaatctgatcgagccagtagaattcacgatcaccttctggcatcacgacttcttgcgctgtattgacgtggatttcaagggcattggcttgggtcatcgctaccgctttttgcgcaaccgataggtcattaccagcaccgatattagcgaggatgaagccagccgggttaaattcgcgaatcacactaaacgtatcaacgagtgtcggatctttaatcgccacggactgtgaaccggtggccattggtaagccagcaatctgtgccacttgtgctaattgggcatttaactttttagtttgttggctcccgccagtcatcccattaatgtagaagggactttgccaagtggtcccagcaaattgcgtactaatatcgacatcggcaattgctagttcgggtaaactttgatggataaaacgaagcccgtcaaaatcgttttgacgatcatcttgatgaaatttttctgctaaaaagacatgttcatctttacgatgcgattggatagattgttttggtctcaccatctaatctacaaggtgaacggcaaggtttaaccgttcgatttgattatcacgccatttttcaaagagtgacgttgtatcaattgcacgatcaataatcacaatcccgcaatcaccaccgccagcaccagatgttttagcagcgccaccggcttcttcggcgagggcgcccattttctggagtacaggggtttcaattgcgacgtgactaaaatcggctagttcttgtaataatgcgcgattgtggcgcaattcagcttggatttgttgtaaattgttagttcggaatcctgcaaccatgtcttctaggcaggctttgctagcctttaagaagttttgatagtcagcttggcgttctgtttttgccagtgcgattttatcaaccaaatgagaagttgaagcgggggaacccgtccaaccaatcaagagtgataattcagcaggtggtgtcaataactcgattgataatgacggccaaggaatcgccaataattcgttcaacgtcatcgttggtctagtctctgccaaccattgcttgtcaaaagagcgataggcaatccaaccaccataaacgctggctgcaatatcccctaaagaaccgttaccttgcacatcaagatgggcaatcgcggcgagtttatagagttggtcgttagttagttcgagttcataaaaagcacagagcgctttgactgtcgctacagtgacagctgccgaactaccaagaccatatttcttaccatcggccgagtctaagtcactgttaacccgtagatgatagatacttaatttcttacccgcttggcgggcatattgttccgttaatttaatggcggataaaatataatgaaagggattatcacggttatcaaaaaccatttcatcaccttgtcgttgccaatataaagaattttcttggtattgttttgaaacaatactgccatattcttgactctcttcaattgataccgttacaaattgattcaaagccacaataatagccggaaaaccagtttctactactgcgtattcgccagcaatatacagcttcccgggtgctttagccgttatcaaaccatcagaacctttcacatttaacttattcattatgctcactcacagataggtcacgcccggtcctggttttgcaaccaataattgctcagctgtaaagtagggcgcaagagctgccaagatctgtggcgtttcgcgactcgtacaaatcactttcacgtttggacctgcatccatagtataatagcaagaaaccccttgttggcgcaagcgctcaacgacttctattgcttggagggtttcaggttcgaaataggtgaaaggtgggacggcactaagcgtggttgcatgcatctgcatcgcactcttttcagcgagttgtcccactaaatttatatctttcttaacgattgcgtccttcatcttaggtaagtccgcttgggccgtttcgacccaactgggataataaggtgaggttgctacaacgcttgccataccggctcgactggcaacccgtttttgacgatcgtttaaaacaatcgcaatcatttgaatatcccaatcgatttcttcttgaacgggaatcgcgtatgaatcttgatcattcgtgccccgttgccattcgacaaacccgccataaattgaacgcgtcgcagagcctgaaccccgacgtgcaagtctagataagtcacgtcggtttaaatccaaaccagccgcacgactaccagctgccgctaaagcagcatagccagaagctgaagaagctaatccagcggcatttggcacgtgattagtggtttcaacactagcaaaagctgaccgacctgcttgttggcgaatcaggtctaaaaactgactcattttagtttgtgtttgttcgtcggcttcttgaccattaaaaataatctgatcacgcgtcaatgtttctgaaaacgtgacagtcgtatctgtataaaaatgatctaacgtcaatgataaactgctattttgcggaataatcaagttggcgtctttttttccccaatatttaatgagcgcaatattagtgtgcgctctcgctgtggctgattgtcccatttaattagtgtgtagtgcgtgtaacggttgaatccaagtcttaattgcgccggcttggcgtaattgttgtgcaagctgttcagcattcgtttgtgttttagccagtgcaataatgcaaccgccacgtccgccaccggtcaatttagtccccaagctaccggcttgattggcagtttcgattaaagcatcgatacgtgaattgctgacccctaaggctcgtaaatcatcttgcgctaagctaagattctggcccagtgctgtcaactgattttgcgcgatattggttgcgacggcttgactcaattcaccaatgtgggtaataagtggttgcgtacgctcaggattggacatcatttgattttgaacgcttttaacggcgggaccagtttgccccttttgaccactatcagcaatcaccaagtaaccttggaggtcgatgggtaatggctgtagtggttggctcttaacaaaccaaagtggggtcgttgcacccgtcgtggctgcatcaatgccacttggattaccgtgaatcatattttctgaaagtgctgctagcttaagtaagtcacgttggtttaattcttgatgataaaaagtaaagagggcgcgaataatcgcaatggcagtcgctgcagaagagcccatcccacgttcggctggcaattcactttcaattgtcagtttaaatgcggtttgttgatcgtctaattgttgccagagctgttcgattagtcggcgaatgccttgcatctgaccaatggcttggcttaaagggccactgtaataggggctattaatcaagggttcgtttagtgtcggttgtgccgtcacgcgaacagttgtctgcactgcaaaaatagggagcgcaatcgcgggttgcccgtacacgacagcgtgctctccaatcaaaataatcttagcgtgactgtttcccacactcgtttgcatatgagcttaaaatttattctaggaaccgcaagttatgatcaccaccaagcgctcgtcactaacttgaaggctacttttcaagaaaaaccgcaagaacgctatttctatttagtgccgaaccatattaaattcgaatcagaagtttctattttagaagcacttaagtcagatgaaaatgattacgtcgccgcttctcaaattcaagttttttcattgacgcgattagcgtggtattttatgaaaaatacgccgtattaccaaattccgcgtatctcgacggccggtttaaatatgttggtttttcggttattgcaggaacatcaagaacaactgcaattattccgtggtgaggtcagacataccggctttgtggcccaattaacaaaacaattacttgaacttaagattggttgtatcacaccggcagatttaactgcgatggctgaaaatctcggtgatcaacaagtcgaactcgcaaaaaaactacatgacctaaccattattgcgaccgcttttgaagcagccatgcaaaaacgatttattgaaaacacagccctaatcgatgctttgaccctctttttgcagcaacaaacgctaacagattgtcatttctatgtggaaggctttgcacaatttacagcgcaagaacaagcattattaaccactttgatgcaacaatcagaggtacaaatcggacttatcttagacagagcttaccctaatcaacaacccgatggtttgaattttttctttcaagccggtcggacctactataatttatatcaacaagcacgcctgaatcacgtaccagtcatgatggaccagatggcagacagtcagcgcttaacaccagctttggcagcacttgatcaattctgggttagttctgaaagcccaggtaatcgaaaactaagcccagtgccggttactgatcatttacatgttgtagcggctgaaaatcgttatgctgaactacgctatgtcgcccgtgaaatccggtgcctagtgcaaactggccattatcgctaccgggatttcttaatcttgacgcgtcacttagcaccatatcaaacaatgattgcgccgattttaacggaatacgagattccgtatttctgtgatttaccacaaacaatggcggctcatcccttagtatcactattggagaagttattggacgttaatctccatttttaccgttacgaagacgtcatggcattattaaaaaccgaattgttgattcctaagggcatgtcgattgccgattttagagccgatttagatctctgcgaaaacttgattctgaaaaatggctacgaaggcaaggattggttaaatgatttggattggcaattctatcgtttcggttcttaccaagaaggcacgcggacgacccaggatgaagccttaacggaacgcatcaacgggattcggcgctacgtacaagcgactttaccgccattttatcgtgcactgaaagcagccaaaactggtcggcaagtggcccaagtgctctatcaatttttaattgagcatggtgttgatcggcaattattgaattggcgggatcaagcattagctgctaatcaagtggctcaagctggtcaaccagaacaaacatggtcgacctttatgcaaatgctcgatgaatacgtcaccttgttaggggatgtgtcatttgaagaagataatactgagcaactaaacgaattcaaacagcttctttcagccggttttgcggcagcccaatatgcgcaaattccctcaacccttgatcaagttgtcctctctgaatcggggatggttcagacgaagaaacgccagattacctttatgactggttcgaccgatcaagtcatgccagatcagattgagaatacggcgttattaaccgatcaagatcgccaacgcttattggataatgagggccaagctacgccgttattaaacgagtctagcgtcggcaaaatgaatgctgaaccgtacttgaactacctcgcttttttaagtagtcaaacaacggtttattttacgtacccactaggaaatggcgagggaacagccttcaaaatttctccctacgttgaacgtattagaaatcattttgatttaacaatccaaaaaattgcggccgaacaatcattacaaagcacagagacacctcaaggttcatggcgcagcttgttaagtgatctcattcaagtgagtcgacaagcccaagaaaatcagacgttaattccagaacagtggttaacgacgtatcgactcttgcaacaagcaccgcaaagtcagttcttaacaacgcaattattccaaagtctcaattaccgcaatgaaccagagcgcctgacacctgaaatcgtgactggtttatacggcaatgaaattcatacgtcgatttcaaaactagaagagttctatcaaaatcagtacgcttatttcttgaaatacggtttaaaattacaagaacgtcctgtttttgaattaacaccggctaacacggggaacttttaccacgaagtgatggatcgctttattaaactgattcaaggccaacaaattgccctgccagaattggatgatcagcaaattgataagcttgtcagtgaagtcttggctaaaacctatgaacaacccgagtttaagattttgaacaagacggcgcgcatgggctatattcgccaacaattgacgcaaactgtcaaacgcgtcagcttagcacttcgtaatcagagcctctcaaccaacttacggccgttagcgaccgaagtcttatttggtcaagttggcgcagaaaaaggacttcaagggttaaacttcatgttagatgatcaccgcgaagtaaaggtccggggaaagattgaccggatcgaccaattgaccatcaataaccaaccctacttaggaattgttgattataaatctagtcagcacagttttaatttccgggatgcttactatggtttggccttacagatgttgacctatctcgaaacggtcttgcaagatcaacaggccattttaccagcaaatagtgcggtgaaacctgccggtgccttttacttacatctgaagaacccgacattgacgctcaaacaattaaccaagaaaaaaatgggtcaactccaaaaaggcgagttcgatcaaatgttattagatcaatttaaatacaacgggctcatcgtcaatgatgaggaattactcgaaaatctcgatacaacgcttgtcaacggccaatcgccactctttgccttcagtaagttaaagagcggtaagtttagctctaaacaactcgtcacacttgatcaacttgatttattgatggcacataacgaagacttaatcaaagaagcgggccaggcgattttcgctggggacacagcattgaatccgattatgcgtccggatcgaacgaatgccctaacgttgtcaccatttaagtcgattttccaattcgatgcgatgttacctgaaaataattatcgtcaactagaagcattagacgaaaaagcagtcctcgaacgcttaatgagtaaaaaaggagatggcaatcttgagtaattgagtaacccccaatttacaccttcacagcaagccgctgtcgatcatgatggccacgatattttagtatccgcatcagctggttcagggaagacatccgttcttgttgcgcgggtcatccaaaaaatcctaaacgggaccgatgtcgataccttacttgttgtgacgtttacggaagccgctgctactgaaatgcgccaacggattcaagtagcactccgcgacgccagtgagaaagcaacagaaccagccgttaagcaacgcttacggcaacaattaagtctcgtgcctaccgcacaaattagtacactgcatgccttttgtttaaaagtcattaaacaattttattatgtcattgatcgtgatcccgtattccgcttattgagtgataccgcagaacgactcctattagcggatcaagtatggcaacgggtgagagaggccttctataatcacgaatatgtcaaagaaaatgagcaagatacattattctacgaattagcccaaaatttctcgaatgatcgtaacgatgacggcctgaccgacattgtttttgagttgctcgattttgcaaacgccaatccaaacccggttaaatggttaaataaccttcccaaaagttatgccgttgacgaagctggtttgacggccagtgattatttccaaaaaaaaatattaccgattttacagcaaaccatcaccgaatgtttggaagccttacaagaagctgaacagctcagtcaaacgagcgaaaatctaatgatctatgcccctcaaattgcaactacgcaagcagccttaacacaaattaacgcagatgcaaaaacgttgaattggcaagcatggcgccaacaactaacagatgcacagctggggcctgctaaacggactaagaaattagaacccgacgaacaaattaataaggaccggttgaaagccgatttagatgacgtcaaaaagaaaattcagacgttactggacacctattttgtgtttgatgaagcaaccaccgctaatattcaacgtcaagctggccaattggttcaaaaattggtgagcgtcacgttaacttttagagcagcctttcaagccgaaaaagaacgacgtcatttattggactttagtgatttagaacaactttgtctgacaattttatcggcagaggattcgccggcaagggccttttaccaacaaaaatttagcgaagtgctagttgatgaatatcaagataccaatccgctccaagaaacgattatccaaaaggtcacttctgatcatccacgcaatctcttcatggtcggggatgttaagcagtcaatttatgctttccgattggccgatccaagcttatttaagaataagtataacgaatttggtgtcacggaagctgaacgtgatagtgaacgaatcatcttagctgaaaacttccgttcgcgccgcaatatcgatgactttaccaatctgatttttaaacaattgatggacgaaaatctcggcgagttagactacgacgaaaatgcggccttacaatatggtgctcgttattatcctgaccagcacccaaccgcgccaaccgaactcttgctttatgaaactaagccggaagaggcagttgccaacccgcaattagataagagtgagggccaagtcgtggcggtcgctaaacggattcaagccatgatgactaatggggaacagatttgggataagaaactcgaaaaaatgcggccgattgaatatcgggacatcgttttactagccccaacccgtggtaataatttgtttatcctggattatttcaaacgcttcggtttaccggttgtgattaaggatgcgcaaaactatttccaaacgaccgaagtccaaattatgttagctctacttcaggtgattgataatcctaaccaagatattccattggtcagtgttttacgctcaccaattgtcgggttaaacgaaaatgaattggcattaattcggattaacgataagacggatgattattatcaagcggtctttaactttattgaccaatataacgagcagaaagtcgggcatttaggccaacaggtcatgcagaagctgacgcacttcatggctttattgacgtcgtttagaacaattgctcgccaacaaccgattgtggacttaatttggacgatctaccaagaaactggctttttagactatgtcggtgggatgccagctggacgtcaacgtcaagctaatttacacgcgctttatgaacgtgccacggcgtatgaagaaaatggctttaaaggactcttccaatttattcaatttattgaacgtctccagaaacaagataaggatttagcacaaccaacgagcttagaaaatcaggacgccatctctgttatgaccattcacgggagtaaggggcttgaatttccagtcgtctttttaatcgatacgagtcgtcgctttaaccaacaggatttacaacgctcatatgttttggataatcatggtggtttaggggtcgtttatttagatagccaaaagcggttgaaggtgccaacactgccagagttagcgattaccgcccagaaacgaaaaaaattacgagcagaagaaatgcgaaaactatacgttgctttgacacgtgcggaacaacggttaatcatcgttggccattgtgataaccaggcccaattgatgaagcaatggcaaaaagggcaaaatagtacccaacaaatattagatgatggggttcgcaacgatgccgcaagtttactggactggataggtcttagcttaattcgccatccacaagctaaagattggaccactgattatgagccactactggctttaagtggtgatcaaaccgaatttaagttgattatgactaatgaaaccttacttggtgaaataccaggtagtctgcataacgatcaggactggggacaacaacagcaaaaggcacttcaaacaattgatttaaacagtgggatagcaactgcgattgctgagcaattaacctttaagtatcccgctaatgttgccacccaaacgacggcttatcaatctgtttcggaagtcaaacgcctttttgaagaccctgataataccgggttgggacaattagacctagcggctgaacaaccgcgccaagcaaatcgctacgtaacggatagcttagcgcaaccacagttcttacaaaccgttcaacaaccaacggcagcagaagtagggaccgcaacgcatttggtcttgcaagaaattgatttaacgcaaccagtaacgctagcgagtttgcaagcccttgtcgatcgacttgttttacagaatagtttaagcgccaatgttgcggctaagattaatcttaatcacctattaaccttctttgaaagtgacttgggacagcaattattagcccatccagaagcggttaagcgggaagtgccattttcgttgttattaccagcagaaacgatttttgaaggcattcgtcccacagatgacgatcacgtcctaatccatgggattatggatggttatttattgactgacgacggttgttatttatttgattacaaaaccgactttattgaccccagtgatcaagaagcggcgattgaacgggttaaaacccgctatgctggccagattaacctctatagtgctgctttaaaccagattgcccaaaagccagtgacccataaatatctctatttattgtcaattggcgagttggttgagattaactagatgaaccgagagactatttatgccgttgttgatttggagacaacgggaacgaacattaaagatggggaccgcatcattcaatttggttgtgcccttgttcaaaacggcaaaattattcagaccatttcacaagatgtgaatccactacgcgacgtaccaactaaaattcaacatttgacgcatattacggctgatcagttagagttagccccaatctttgaagatttagcgcccacattagttgaaattttatctggcactgtttttgtggcccataatattaattttgatttacctttcttaaatggcgagttaacgcgtgtcggcttacaaccattagatttagcaggaatcgatacggttgaattggcccaaatcatcttgcccgaggcgcctagctatcgactacaggatttaacccaactattagagattgaacacgataatccccatcaagccgacagtgacgcgcttgtaacggctaaacttttcttgaagttaagcgcccgcttacaggctttgccatcggtcacccttaaccgcctgagcgaacttggtgaaggattgttacggcaaaccggtgatttctttaccgatactgcccaacagatgcgcgaaaaatcgcagccactccccaacgaattgttaattcaagaggagattgcacttcgtaagcccgcaccagttgattttgaaatttatccaggttcaagttatgcggcccagtaccccgtaactgaagcagaaaaaaagcgtcttttaaaaccacatttgaaatggcgtaaggctcaggcaacgatgatggatttaatccacgataatttcgagtctgaaaagccggaaccattgttaattgaagcagcaaccgggttagggaagacgattggctacttacttccatatagttatcggatgtcacgtgatcataagttagtggttgcgacctcaacgacgctattacaagaacaaatcctaactcaggccaagccactactagagcgcttggttggtcggcaaatcaatgcggcggttgtcaaaagtgcgagtcactatattgatttgcatcgctttgaattatcattgcggttaccgcataaaaatcgaatgattcgcttgttgcagatgaaaattttagtttggttaacgcaaacaacgacaggtgatttagatgagctcaatttaaccagttacaaaaccccattttttgtcagcattcaacatagaggtctggctagtttgaacccccaagcaccgttttatcatgaagacttcctaagacgattgacacaccggcagcaacaagccgaattattggtgaccaatcatgcttatttagcaagtcacgcggatgaacaacaaatttggggaccaaaaccttacttggtcttagatgaagctcaaaacatggtgtttaacgtgcagaccatttcacaagagacttggtcgttgtccagttggcaattttgggcccaaaaaggactccaatatacgacaggggcccaaaccaataatttggtgcgactatttccagcggaaacaccgcagaatcgttcattgaagttattgcataagacattgggtaagttgacccgcactttaacacatttagaaacttatctaacggagcagtttgagccagatgaaccaacagatggacaaacttttagtgaacggtatttaaatccagacgaagtcattcaattcgttaatgctagtcagcgtgagtttggccagttaaatcgagaattgttaacgattcaagatcatttcttggcgttacgctatgccctagaagatcagttggcacgttataccgaatctgatctagcaatttggcaatcttttgaaaatgaactcaatctcttattagcagatgttgaccattatcaacgctttgaacaactattcattgcgacgaaaccgcaggaacgccatgcgttagcgattcaaattacacggcctagtcaaccgagtcaattaccgcaatttaaattacactggcaattgttatcggctgggccccaaatgcaacaagtattaagccactttgaacctgttacgttaacgggcgcgacgctagcggttaatggtcatttcgactatctcaaacgtgaatttggttttactgaagagcaagccttacaaactaagaagttaagaagtccattccgctttaaacaacaagcccgtttttatatcgcagaggatggcccagttcaaaaagaactaacgccaagcgattaccatcaacaggtagcagcgcaagtgatgactttaattgccaataatccgcatcaaacgctcattttatttaatgccaatcaaacattagaacaagtttattacgcattaggtcgtgctgggttatcactcgatcgtgaagtgttggctcaaggcattaccggcagtgccgaaaaaattactaaacggttcatgttaggacacgattcggtcttactagcaactagtagttttgtctcaggggttgattttcctgaggccgcccttgaaatggttattttggttcaattaccatttgatgcgcccaatgcattgcagacacgtgtccgttatgcacaattatcagcccaagggattaatccgtttaaggctgaagcactgcctaaggcaacgatccggttgcggcagtcatttggccgcttaattcgaacgccaaatgaccggggcttattcatttgcttggatccacggttgttgacgacgcaatatggccaacaaatgcgccgtgctttaccgtcgagtctgcctcaaaaggcggcacctgtgcagacaattagagagctcagtgatttattttggttaaattctgactaagtgcgtaaatataagagatggatatgggtatttttattagtagtcttgatgggcacgatgtttttcgtctaccaccaagcgcgctcacccgaagtcaccgcagaagcgaaggcgaccaagattgctaagaaatacgctaagctagaaaatccagatggtttttacacgtaccatcgcaatggcacgtattacacagtcagtggtcaagataaaaataaaaatggcatctatgtattaattaacgaaaaaggcaatcatgtgaccgtttatcgtcaatcaaaagggatgactaaaaacgaagcccttaaaaagacgtggtccactaagaatcctcaaaaggtcctcaatattaactttggtttttataagaataaacctgtttgggaagtcgtttatcgcagcgacaagggccgcctttgttatttaacgcttgatttcaagaccggtaatacgacccaattaattgaaaatatctagatggttaaaaaaatcagtattattgacgctaaagaccatgtcgatgaagaagtcaaaatcggcgtttggttaaccgataagcgttctagcggtaagatttcattcttacaattgcgcgatggttcagcctttttccaaggggttgttgttaagagccaagtaagtgaagaagtcttccaattggctaaagacgttaaacaagaatcaagcatgtggattacaggtgtgattcatgaagatacacgttcacatttcggttacgaaattgaagtctcaaatattgaattaattggtgacagtagtgaatacccaattacacctaaggaacatgggatcgaattcttattagatcaccgtcacttatggttacgttcaaaacgcccatttgcaatcatgaagatcagaaatgaaatcattcgtgctacttatgaattcttcaaccaagaaggcttcatgaagatggacccaccaatcctaacgggtagtgcacctgaaggcacaactgaattattccacatcgaatatttcgacaacgatgcttatttgacacaaagtggtcaattatacgcagaagctggggcaatggcctttggtaaagtctttaccttcggacctgttttccgtgctgaaaaatcaaaaacacgtcgtcatttgactgaattctggatgattgaaccagaaatggccttcatggaacaagatgaaagtcttgaagtccaagaaaaatacgtggcttaccttgttcaaaacgttatcgatcactgtgcctatgaattaaaattattagaccgtgatattgaccaattgaagaagtacacacaaacaccatacccacgtatttcatatgacaaggctgttgaaatgttacaagcagctgactttgatattaaatggggcgatgatttcggtgcaccggatgaaacttacttatctgatcaattcgaacaacctgtcttcattttaaactaccctaaagccatcaaacctttctacatgaagccacatccaacacgtgatgatgtctacttatgtgctgatttattagcaccagaaggttacggtgaaattatcggtggtagtgaacgtgaaactgacttcgataaattagaagctgaaatcaaatcaatgggcttagatattgaagaatatcaatggtacttagatttacgtcgttacggttcagtgccacattctggtttcggtttaggcctcgaacgcgcaatcacatggatttgtggtatcgatcatttacgtgaagctattccattcccacgaatgattaacagaattaaaccataaatgaacgaattaacggcatttatagagggcggtcagcttagcgtgtcgcgcttattattacaacactaccaaacgctcagaatgtcttctgacgaactggttgtttatttacaactgagtgattttgccagtcaaggggatacttttccagacttagcggtgattggtgaacggatgggattggcgccaacgcaaatttatgagttgatccaccaattgcttaagaagaaaattatcgcgttaaactcaaccgttaatgaacaaggacagccagttgatcattatgatctaacaccagcattatccaagctcagtgtcctagctgtccaacaaaatcaggcagcattaaattcgcaagaaacgaatcaacgtctgtccgtcttcaaccaaattgaacaaacctttgggcgaccattatcaccactcgaatccgaaattatctcaaattggttggatttagatcattattcagccgaactgattcagctcgcagtccgcgaagcagtcttaaaccaagtttattcacttaaatatgtcgataaaattttattaaattggcaaaaacaaaatatccaaactaaagaagacttacaagcctatcaaaaagcacatccacgacgttaaatgttatcaaaagcaaaaaccagatgggccatgacgcaactgtacgaccttattccggatgctaaaggggccttaattgcggacagtccattccaattactgatcgcggtgatgttaagtgcgcaggcgaccgatgtatcagtcaataaagtaacaccacaactatttgaacatttcccaacaccagccagttttgcggccgcagacctaaccgcaatcgaagctgatatccgttcaattggtttatatcataataaagctaaacatatccgcacttgttgtcagcagttaatcacggattttggtggtgaagtcccgcaaacccatgctgaactcgagcaattagccggtgtcggccgaaagaccgccaatgttgtcttaggcgacgcgtttaatgtgccgtcatttgccgttgatacgcatgttagtcggattgccaagcgattaacaattagtgctgaaaacgcctctgtgcgccaaattgaaactgactttcaaacaaagcttcccaaaaaagaatgggtccaagcccaccacacgttaattttatttggtcgccaagtctgtacagcgcggaaccccaagtgtaatcagtgtccgttattaagtatctgtcccgcagggcaacgaatacttcaagaacgcggttaattagtgtgtcgatgtttgtgttgatattgatggttggctcgtcgactgactagttgtcggtgcacttgacgaactagctggtgcttcagaagaagaacttactgttgaagaagattcacttggtgttgatgacacgcttgaacttgattcaacagagctactactttctgatacactgctttcagaggcggcaacactttgacttgaactttgaactgaaatcgaaggtgtttgagactcaatcacactgtgtgttgaggagtaagaagagcttgtcgaatcctccgcaaccgtagctgttgttcctttaacgaagagctctctaacaccggcaatcgttttagcttgaactgaactaggcattgtccaatccgtatttgaaacattttgtgaaaggtaaaccatcattgcgcggtaaatataggccgcaatgtttcgttcctccatcgttaaaccattttcgagtggcttgtcgtaacccgtccaaacagtaatggagtagtgcttcgtgtaaccggcaaaccaactatctttcgcaaggtctgaactgagtcctgatttggctaattcttcactcgaataatcggttgtcccggtcttaccagcttgatgtaatcctgagatctgtgctaacgtcccagaaccattcttgatgacgtctttcatcatatcagtcatcatataggcagttgagtctttcattgcgtcagagccttcagaattgtaattatgggtaacaccatctgccgtttcaactttattgatgtaggttggtttgtagtaagttccaccattagcaaaagcgctataggcagctgattcttctaaggtagaaacattaccaccaatcccataggcaaggccggtatcttcaggaatcgtaatccctaagcctttaacaaacttacgtgcacgcgtcataccgacatcttctaataagcgaattgcgggtacgtttcgagaattagctagcgcattacgggctgtaattgtacctaggtagcggttatcgaaatcgtgcagttgaatgttggtacctggataaatataggctgtatcttgtagtttttgagccgttgaataattaagatattcaatcgctggtgcaaagtccatcattggtttcatagaagacccattactacgtccggaagagactgcccggttatagcccaattggacatcaccagttttgcgaccaccaatcatcgcaacaatcttaccgttgttagggttagtaatagtgacggctgtttgcattttgtcatcagggaattgaacggttgtatcgtcattaacggtattatataacttcttttgcgcatccatgtcgatattcgtataaactttcaagccgtctttataaggatcatagccttttttcttgaggtctgtaataacttccttaacataggcatcagttgctttagcgttcgttgattcattggtttcagatttctgtgcgactaaaccagtgttaatcggaacagctttagcttcagtcgcctctgcttcagaaatcttattgttccgttgtaaggcatcgattactaaatcacgacgtgtcttggcttgatccggatgtgcataaggatcgtaattagcaggggactgtggcataccagcaatcaatgctaattgtgggagactcaattgttttaacgtcttatcataatagtacttagcagctgtttgcataccataaacaccattattcaagtaaaccttattcatataatattccaaaatttgatccttagaatattgtcgttcaacttgaacggccaaccaagcttcttgtgctttacgtttgaaggtttgatcgctgttttttgttgaaaagaccgataacttgattaattgttgcgttaaagtactcccaccctgtaggcctaacgaagagtgcccagtaatgttagcaaaggccgccgatgcgattcggactggatcaatcccaaatttctccttataaaagcgtcgatcttcgattgaaaccacggcatcttttaacgtttgtgggatttgatcgctgctagcataagtctgattagcagcccctaattgtttaaaagctttgttattgctgtcatagagcacacttgcattaccgttttgtaatttcgcttgtgtaatctccggggcatcttttgcataatacgcaaataagccaatacccgcgatgattagcgctaagagggctaataacccccatttgataatacggccaaatagcgacttagtacgctttttggtcggtttctggtgtcttgtgacacgtgtgttacctgtttgattggcagacatttaaactcctttgtggtggcgtgcgattaattgatcgacggcctctaaatagggaatacttgggtttaattgatactgaatttcaaacccatcggcaacgatcgccgctagtggaattgacttccgaccaccagttgcttgattgtcccattgtgtaatcaataagcttgccggatacacaaataaacgttgcagtgggacgaacttcataatcacaaaacaaaccccaccttgttgtaagcaagctctaaaatgatcaatttgatgttggtgaaagttttggaacggaaatgacgttttattcttagtttccttcgcttcaaaatccacatagtgcccctgatagatgccattataatcggtggtggaagcttgcttaaagtaggcttccttaataacagcttgactacgtgctggataatcaaccttaacgatctgaataggggtgggtttcttatagataaccgcagcatcacgtagtcgataatattgattactatcgttgatctcttcttctaatgacataccgcgtttaccgtataaggtggttggactagtatgtcgcccttgctttttaggctgttttgtttcatgatttgagtagggctgtccgtttggataatgaaaggccatttgaagcgattatggttaaccggttatcgaagctatgaactcggcgtttttggcgattccgatgagaaacttaaagttattaaatattctttaaaaaagcaacttaataattacctcgatgatggcttagaatggcttatcaccgggggtcagatgggtattgagcagtgggggattcaagttgcacaggaacttaaaatagattatcctgaattgaaggttgcgatgatgctaccgtttagcgattttggtcaacagtggaatgaacaaaatcagggcacgttgatgacgttaaaagcccaggtcgacttttgcgaacccgtcattaaagccccgtattctgggccccaacagttgcgccaatatcagcagtttatgctgacgcatacagatggtgcattattgtactatgatcgtgaagcacctggtaaaccagaatacgacgctaaagcaattgagacctatcaagaacaacatgagtatcccaataatcaggtcgatttttttgaactgcaagatttagcaaacgagttggcggagttagagaatcaagctttttagatggataatcaattagaaatcgaattaaacccaactgaaattttgaaaaaagaatttaagtcaaagatgcgcggctatgatcctgaagaagtcgacggttatttagatttagtgattaaagattaccaaacttatcaagaaaatatcgatcgtttaacggccgataatacccgcttatttaacaaggttgaagaacttaatcgtcaactaagtgcttctgacagtgttaaagaagtcaagccacaacaggcttcagcagcaactaactatgatattttgaaacgtttatcaaatcttgaacgtcacgtatttggtgctaagttaagtgaccaaaatggtgccactcaaacaagagttcaaaatcattcacaatttgattagatgacttaccaactatacgctacaatggcaagtggtatcgaatccattacggctaaagaactacagaatttaggctacgaaacgcgttcagataacggtcgggtttatttcgaaggtgacttggcagatatcgccaagactaacctttggttacgcagtgccgatcgtgtgaagattgccatcggtcaattcgaagcaaaaacgttcgatgatctttttgaacaagtgaaagctttgccatgggatcaatatttaccactagacgctgcctttccagtagctggtcgttctgtgcgttcaacactccatagtgaaccagatgtccaagccatcactaaaaaagcgattgttgataagttaagtaccgtttatcaccgtcggacgcgtttagctgaaaccggttctgtctatccgctagaggtcagcatcttaaaagacatggtgacaattagtttagatacaaccggtcctagtttgttcaaacgtggttaccgtcttgaaaaaggggaagcgccattgaaggaaaacttcgcggcctcattaattctccttagtcgttggcaaccagatatgccgtttgttgatccaacgaccggttcaggaacaattgcgattgaagcggccttaattggtcgtaatatcgcccctggtatgcaccgtaagtttgcttttgaagactttgactggattgacgctactgttttagctgatgcgaaggctgatgctaaagcacaagaaaaaccagatcaaaaacttgaaatcttcggttatgatattgaccaaaatatggttgatatcgctaagttgaacgctaatgaagcgggtgtcttacatgatattcagtttaaacaattagctgttaaagattttaaaacagatttaacgaacggggtcatcattgctaacccaccatacggtaaacgtttgagtgatcaaactcaagcgcgggtattgtataaagaaatgggcgatacttatcgttcattaaaaacttggagtaaatacattttaacaagtgatttacaattccaagaatctttcggccaacgcgcaacaaaacgtcgtaaactttataatggtcggattcagactgatttattccaatattggggtcgtccagtatggccacgtgctgaaaaagccgaaaaataattgacagtcatattagcagcagaaccaattcctgaacaacacgtagaagatttacgacaacaagggttaaccattatcaatttggatgacgtacaacccgaacaattggcaaccatcgatattatgtttggttggaataaagtggtggggcctaaaattttagcaacaccaaatcatcgcttgaaatggattcaagcagctagctctggtgttgactatttaccattagcaacattgagtgaacaaggcattatcgtttcaaatgccaagggtatgcacgctgttccgattgcacaaactgtgatgagttatattttatatttcactcgcggtattcgtcaaagtttgagttctcaagctaacaaggaatggcgccatcatgagattgggcgcgcgaccgaaacacttgagcgccgaacaattatggtctttggtaccggacaaatcggtcatcagattgccgtttacgctaaagcgttggggttaaaaaccatcgggattaatcgtcacggtgaaaaacgcgatgcgtttgacgaaattttaacggatcaggattatcaaacgaaattagctgatgcggatttcgttgtgaacgtgatgccgttaacaccggaaacggaaaactttttcgatacggcattctttaacgcaatgggtgaagggcactactttttcaacctaggtcgtggtgcttcaattgatgagacggcgctcatggcacaattgaataatggccatctcgcaggggccgcaattgatgttgcgcaaactgaaccattgccagaaacatcaccactttggacgacaaccaatttagtgatcaccccacatatctcgggttacattccagatattcacgaacggctctttagaatcttcgaacagaatttaccagtcttcttaacggacgggcaacttgctgttaaccaagttgatttatcggctggttactaattatagaccgggaattggttccgctaataaacagttatccgctcgatcgtaataactgacaactttttgggttaaatcacttcgccaataaataatgccagcagctgcagctagctcacaaaatgtttcaaaagtaatttggccagtttgtgctttttggaccgcagctttaatttgagtggtattacttttaggggtaactttttgtggcacaccattcattttcaaatcaagataaccatcattatcgtaatagcgatattttccggattcaacaaggtaatcatatttaaggacacccagttttttaaaggcctgcattaattttggaaagtcaccagcattctgttcagcgtcgaccgctttttgaattgcgttataatttaacatatgcgaaaatcacgaactaaaaaaggcaaaaaattaaacgtacagcctttaaggaccaaagacgagattgaggacatgaaagttatcttacgacactcccaaatgggtagtcggaattatttactttttttattaggcatcaataccggtttacgttgttctgatattgtccaattaaaagtgaaagacgtaatcgaagacaaccccgtcatcgtcgaacaaaaaacaggtaagtggcgccaaattagtttaaccagtttgcgaccctacattagtttatatattcaaaataatgaactgactggtaacgactggttattcgggagtcgcatcggtgatagtcacattacagtcaatggtgtttatcgtatgttgaccgaggcgggcaagaaactcggccgcaatgatattggcacacatacaatgcgcaaaacttacgggtattggttctataaacaatttggtgatgtgcgatcattaatgattgattttggccattcaacacaggaaacgactttacattatattgggattacccaagatgaagttttaagtaagaaacaacaattggcaatcggcctttaaatgaaagcagcaacttttattgaaccaggaaaaatggtgattactgaggcacctaaaccaacaatcgaaaagaagacagatgccgttattcggattattcgggcttgcgtctgtggctctgatttatggtggtatcgtggcctttcaaaacgcgaatcgggatcactagtcggacatgaagcaatcggtgttgttgaatccgttggtgaagcagtgactgatattaaagctggagattttgtaattgtcccatttacgcatggttgcggacactgtgctgcttgtttagctggcttcgatggtgattgtacaaaccaagaaggcggtggcaatggtggttatcaaggtgaattcctccgttataccaatgctaattggggcttggttaaaatccctggccaaccagctgattattcggacgagatgttaaataacctcttaacactttcagacgttatggcaactgggtatcacgccgctgtttcagctgaagttaaacctggtgatacagtggtcgtcatgggagatggtgcagttggtttatgtggtgtaatcggtgctaaattattaggcgcaaaacggattatcgccatgagtcgtcatgaagatcggcaaaaactagcactagaattcggtgcaactgatattgttgctgaacgtggggacgaagctgttgcaaaagtgatggcgctaactgacaacgctggggctaacgccgtcttagaatgtgtagggactgaacaatccgttgcaacagcggtagctgttgctggtgcgggcgctgttattgggcgcgttggaattccgcaaaaggcagaaatgaataccaacgtcttattccgtaagaacatcggcctccgtggtgggattgcggcagtcacaacccatgataaagcacggttactcgactctgttttaaagggcgaaatcaatcctggtaaggtcttcacgcaacgctttacattggatcaaatccaagctgcttatgaagcaatggatcaacgccaagctattaaatcgttattagtgattagcgattaaatgattttccggttaattagtttaatttttgtcattttattactgcttagcttctggattaaaattccatttttcaatgattaccgaccagttatgattcttatatatggtcttacttactatttcgttgatcgacatcagcgactaacacgctaattaaatgagtttaagtaaataaccacctaagcaaccaaagataagacttaataaactaccaattaagtagtattctgcaaaatgatgttcattggcttcaatggcgcgaaaccgtgtgagggctttgattgcgacgacgaccgcgatactcgcaacgttattggtatagcataataacagaatcgccaaacgttctaagcgaccgatgtgccgacccagttgtgctcggtctggtagtcgttccacatttaaatctaagctttttaaaaataagctgatgaaataatcggcaaaatataatgtcgcaattatcacacttgcggctaataaccaccgactaatcgtagttgactgccaattagtccctgataattcactaacaatgacaatcacaactaaatgcaaaacctgatctaaaacgtaactgattagagggacttgattgggttttaagcgtaatgcacgtttcaaaatgggttggcaattctgcttagtgacatcgattagccaatgcgttagcacaacgattattaaactaatgccgaacgtttcaagaaaaggccagtttgcaacacgcagtagcgttccgattaaccagatgccaactaccattggcacttgcgtcaacgcgtgccccaataagggataccatttaaccgccaatttcgttgagcgtttgcatcgggccatctgatcggattggattaaaaaatccgtccagaaatgggccaatagcaaaatcgcaaataacgtcattcatgcgttcacctccgtcaaactcattagttgcgctcgaaccgttgttaacgtctgctcaatgagcggataatccatctgattgagcaaccgactgatcttactagaagcgacagcacgctctttttgctgcgtataatccacctgataagtcagattaccatatgcttcccataaaatttgagccagctcataacgtttcaagttcggttgcgcataaagtagagcaaacgtctcttttcgcagcttcgtgtttaatagccgttcataaattaaataaaaaagggcactaatgccattagcggtttctgcagcctgatcagtgactaattgccacttaaaaagagaggttgaaaatggataaccgaggggtaaagttgcgccttgcattaggcgttttgcctgatcaaccgcagttaaggcattaacaattgccgaaccatttacgcgattaacatcctgataatctgccttttcaactgtaactagttttcctaaaccaacgccaaaatagaattcaggaaggtctactgacccaaaaagcggttcccaaaattgtctaaaagccacactgcgcaaataggcattacagaaaataaataaatctgccaattgcgcttggtctgccgcttgaaaaccacctaataacccatcaccatcttttaccatgaaaggggtgagtaaatccgggaaacgatcattcagttttttctgcaggtgctgtaataacgttaaaacttgcgtttgatcggcaaaattcgttcgactaccaactaaatcgataaaacaataagcagcttgcatttgttttttgaatttaataacgaaactcctatctatcgacagattgccgaccaaattgaagaagggatttttacgggcgttttcccaccagagagtcagataccttcaacaaccgagatatcgcgacaatttaatattaacccggccactgttttaaaaggtatgaatcaacttgtcgaaaaaggcttaattgaaaagaaaagagggcgcggtatgtttgtcacgacaacggcacaaaaacaaattaatcaacaacgacaagatgaatttttcgatcattacgttgcagcattcattacagaagcgcaacaactaaaattatcgaaggacgacttaattgcactgattgaaaggggctatcaaaatgactgaatgactgaattaacaactgaacatttgattaagcaattcggtaatcgggttgtattagatgatatcaatttaactttaaaaccaaatatgatctatggcttactagggcgaaacggtgctggtaagagtacattattaagcattatagcgaaccaaataactgcttcaagtggcacaattaattgggataaaacaccgttaaccgggcgtgatcatcctttacaagccatttatctcatgtcagaacaaaacctattcaataaagaaaatcggcttaaaaagattatgaaagataccgccttattacaaggggccttcaatcaaacgcttgctgataaaatgttagctgatttcgaactcaatcccaaacaaaagcttaatcaactctcaactggatatcggacaattttcaaaacaattgtcgcgttatgcgtgccagcggattacgtttttctagatgaaccaattctcgggttagatgctaatcaccgcgttttattgtatcgctatattttggaagcctacgaaaatcggccacggacatttgtcttatcaactcatattatcgaagaaatcgctaacttaatcgaacacgttttagtccttgatcaatctcgaatcattattgatgatgatctagaaacggtcctcgatcacagttatcaaattagcggtcctaaagaagacgtcttggcatattgccaggaattaccaatcttagcgagtgaacaaatcgggacactctacactaactatctctacactgagttacccgcagaccgggtgatccccgatcgcgtagcaatcaaacatgttgatttgcaaacaatcttcattaaattaactgaaaaggggcgtgaacagcatgtttaaatgtttaaagcaatgttacgctatcgattaacggccatttggaaaacgttgctaattgcgttagcgattggtgccgtcgtaacaactgccagtgaattaattttaagcaaacaagcatttagtataggattactaggcgctagtttagcaatgaccggtttaatcgtcacacaactctgtctcattgtcctttcattcacaatgacccgcccctattttgagtttgggattctaaatggcatttccagaaaaacgaattatgcaacacatctggttagtctattaggtagtcagcttgtgacctttatgcttttttatcccgcaacagccgccatttttcaatcacacattgaagacaatacgaatctgtttgatccgtatctcatgttcatcatgattattggtacttggattgtgatcgctagtgggattgaaattagcagctttattactttatttgaacgtaagatttggtggattgtgattaccttatgggtagtactagatattctttttgaacattatgttcatcccgttattaattcaatcttacccacttggaccaagctcacagcgctcaatttcaataacgctagcattatgacagctgctaaagtggttgtgatgagtccgtatttctggctaactgttttcaccagttttgttttcccattgttagttgcgtgggtctgccaatacttcatgcaaaccaaaaaaatcgcgctcaagtggcgtcgttcagcttaaatgataatcactaaacaagcaaacttagagcaagcacaattggtaaccgcaacatttggattcactaattctaaaaaagatactgcattttgggacacgactttaaccccattactcaatgagatcgaagccgatttaacactcgaacaaattcgcgagttgcctaacattattgcgacgaaaaaagcgtataaagcagtcggtcttgatgcagcacgtcatcgcccatcttcggatagtttattacgccgcgtcgttaaaggacagggactctatcaaattaatgcgttagttgatgtgaataattatctctctttgaagctacaactaccaattggtagttacgacttagctaaaattgacggtccaatcagttatcaagtcgctgaagaaggggccgagtacgccggaattggtaagggcgcgattaacatcagccacttcccaacgctagtcgaccaacaaggtgcgtttggcagcccaatttcggattccacacgcgcaatgattgcccctgaaacgacagaagcgatgattgttgtttatgcttttggacaatcaccagcacaattaacggcaattgaacaaacgattaaaactgtcctccaggcagcctttaacccagaagaaatcataactgaaattatcgcataattattgcgctaataattcaacaagttctgtttttggaatgcctgtaaagtaaggtgttgtgtcaattggttcgagggctgctgctaagtgttcacggtcataaatcgttccggctaatttttctgctaaatcattagcatcacctgaaccgaagaaatcgccgtagaatttaacgttggcaatcttaccattttcgatcaataagcgggcatcaatcgtcccaaaatcaaagtgtttccgcttttgaattgttgatttaggtgacttgccataaacccagtcccagttactatagagatcattgaaaatcttgtcgatggcttgttcatctgccgccgttaattgatattcacgatcggcaatttctggtaagctcttggcattaaaaaggttcaagagtaagacatctctaaattcttcggtcgacatattttgatattcagggttcacgtggtcttttaaattagttacccgttggcgaatggacttgatgcctttagaagcaatcttatcagcagggacgttcaacgcttgtgtgaggacatctagatcgacgttccatgaaagggtcccgtgagagaacgttttgccgtttttggtatacatcgcattgccagagaatttcttaccagcaactaaaatatcgttacggccagagacttcagctgatgttgcgcccatttcgtgaagtgcatcgacgattggttgcgtaaaggatttgaaatccccaaattgttctgaatcagcatcgacaacgaaactaaaacaaaggttgccgagatcttgataaataccaccaccaccagataagcggcgggtcaccgtaatgtgattatcctcaacgtatttttgattaatttcttcatacgtattttgattccgacccacaataatacatggtttttcaatatagaaaagcaataatggttcatcaaagttcttttgattcattaaatattgttcggtggccaggttacggcgaatatcatttgacttcataacaacgtaatacatcagcatttaatcatctacatattctaataggtcgcctggctgacagtcaagcacttggcaaagacgctctaatgtcgaaaaacgaatcgcttttgccttttccgtctttaagtttgaaaggttggcaatggtaatctcaactttttgtgaaagttcagtgacactcatctttcgttgggccagaatgacgtctaaattaacccgaattggcatttagactgtgaggtcgttttccgtctgcaatgcaatagcgctcttaaataggtcttcaacaatctgcatcagaatggccaaagcaaacggaataaagatgagcgcaatcccaagtaataacaagcccggcgcatcttctagttgcgtaatccgatagaaaaagggcagtgacaataaactagcaaaacttgcgattaagaccgcatttctaatcgatgatacataacgcaatgtttgtggcgcaaacacttggtgttgttcaatcgtattgagaatgcgatgcagcgcatataaggcaacccacacacaaatcgtcacactataagcggccagtgccaacgtgataatttcaaaaggatagtctaatttagctgccgtcacaatctggacggtaactaaaaagctaaaaaggaagaagactgcgccgattcctaaaagtgctaaacgtaaaagccatttttttaacatgtgaaaatgagacccttattgttgccaatcacgttagtaatcgtattgttaatgctaacggcttgtcagcaaactccagcaaaaacaacaagctcgcggcacaattcacaatcagaaagtatcagccggcaaaaccaacagacctacaccaaaaaaacggtccaaccctattggttgtattatcgacataagacgttcttcgtgattgcgcatcaaccgaatgagcagctgaacacgaaagataagctcaaaacgtttttgagtcaaaccactacgcaaacactagcacacgattcctatcaaaaactggacgaagacggcttcattctcattgccgataatcagtttaaaccacaccaagactttggctatgggatagttacattgggtattccacgcgacttcacacttcaagccatcgttaccacggccaatttaaacgatccgtcctataatcgctataaaatttatcaaattcgataaatgaaaaatagcaaattagatctgatatttcctatcagtttcgttggtggtggtgtcttaatgcaaattcaagacctctattttaatccgaacacgatttggattcgcacaatcatgaccggtattgcattaagtatcatcacttatctgatactaatggttaaacgtcaaaaataattgaaaaaatgcatattccttctcattttatgcctatcaaccgtaataatttttattgttggttgcaatcgttcaattgaaacacacacatcacccaaaatacggactaaaaaagtgactagtttgcctaagcatggaaccatgaaattaacaactgcgactcattcggatcaaaagaaaatctcgggttatatctatcgtgtcggcaacgattatttagtcttaaattctgcaaaagggtttatcaaagatgccactgctatgaaacattatcttaaattcggtaaagagcaggttacaaatgcgtattttggccagccaaatgtgtttgcaatcgccaaaaaacaggtgggcaagcatgctcaattatttaaactcgcatatgggactgtaacttacgaaacacttcctgaaaatgatcgcgctgatatctcttttagtattattacggataagaacattgatgaattacccaaaatcaagattgatcaaatcgactaccaaataatttaattagtcacgacgttggtacgcgataactgtcagtggcataaatagcataatgatcagcgcaccactgatgaggaccattgttgctgtattgttccaactgccagtatttaagatcgtccgaatagcggtaattgttgtgctgaccggattaattctaacgactggctgtaaaaagtgcggcagcgttttgatgggaataaaggcgttcgataagaacgttaacacgaggataataatcatcgataagctgctgatcagctctgcatttttgaccattaaccccactaaggcaaaaatccaagaagttgaccagccgataaagaccgccagtagtaatgccccgatcagtgcccccagattgacggtggggcgccaacccattaccaccgctgtaagaatcgccattccgccagaaagtactaatcgcaaaatatcacctactaattgccctgccagtggtgctattggggaaatcggtaatgttttaaaacggtcgaagatgccgttattaatatcttcccgtaattgttggccagaaccagaagctgcgtttaaaatgctttgaactaaaataccagaaaccagcatcggtaagtaggcgtggacgctaccggcgatgacgccgccgaatagatagccaaacaatagggtaaagataatcggttggatgagcacatcactgacgttatcgggattgtggcgcgtttttaataagttacggtgggttaaagtgagaatatcacgtatagtatgaggttttattatatttgtattcatttagtttttaccaaccgtcatttttaggaaaacatcatctaacgaaggtgtttcaagttttaaatgactaactgtaattttagcaatttgtaattgatttaatattgcggttatcgctggaagagcgtcgccaccaagtgggctgactaatgtctgttcactaacgctgattggttgctttaaaacgtcctgaacaatcgcgcgtgcttgaggtaattgagccaactctgtgacggctaaagacagttgtaagccacctaatttttgctttaattcactaggtgtaccactggcgataagttgaccgtgatcaatgagtgcaatgtgatcggcaaattggtcggcttcctctaaatattgagtggttaaaaagacagttgatccttgggccaccaatgcttgaattgcttgccacatttgaattcttgttctaggatctaaaccggtagtcggttcatccaaaaataaaatcttcggacgacccactaaactgactgctaagtctaaacggcgtcgcatgccaccggaaaaagtggccaacgcttgattagccgattgcgttaaatcaaaagccgtcagtaactcgtctgcacgaatccggctggcttgactgctaagtccgtttaaccgtccaaataaacggagattatcacgtgcacttaagtcttgatcaatcgctgccgtttgattcgtcacgctaaattgttggcgtgcttggcgactttggcttagtgtattaaagccatttagcgtaatctgcccctcatcagggcgtaataaagtcgtcatcatttttaaaagggtcgttttgccagcaccatttgggcctaagaggccaaatatttcgcctttttttacattgaaagaaatatcttgaacgactttcttttgaccaaattttttttgaacatttccgacttcaatgacattatcctcacgcatatgacaaacagcgtcaaagcagaattagttgctggtaaattagccgaatatgaacaactcagtaaaatctatgatgatatcgtcaaacaagcgcggccccatctgattgtcgaaggtcaggggaaaatcttattggcactagctgatgaagatcacttatctcaacgagaactcgccacgcgtttaggcatgtcaccacaatctaccagtgaatttgttgcgaaacttgttaaacgtgaattggtcactttgaccaagttaccgagtgatcggcgggttaatttagtaaatctgaccgctgctggtcgccaggaaatcgaatccgctagtcgagaagtaccaccatttgtgaacgcactttctgaagcagaactagatcaactcgtaccgttactgacaaaaatcacaacagcagtgtatgctgatatcgacgcgtctaatcccacattgggcgttaaattccataagttactggctagtcggtacttaaatcaatttaaaaaataattaatcgaagtcataatcactgtcgttcattgcttcaacgttacccaagcggtaaccattcccaacttgtgagaagaaatcatggttcgctgttgatgttgacatcccgtttaagacaactgggttcacatcttcggctgtatctgggaagagggcgccttgtcctaagttcattagagccttattggcgttataacggaggtaagttaagacttcttccgtccagccagtgccatcgtaaacttcatgagtgtacttttcttcattggcataaagatcgtaaagtaaatcgtacatccagttttgaagttcttcttgttcagcttttgctaattcgttaaagccgagttggaatttataaccgatgtaagtgccatgaacagattcatcacggataattaatttaatgatttcagcaacgttagccaatttgttgttccctaagtaatagagtggggtatagaaaccagaatagaagagaaatgtttctaagaaaacactggcaatcttttgttggagcggtgagccattttgatagatactgttaatcttattggctttgtattgcaggtattcgttagtatttgtccagtcaaaaatttcatcaatttcattaggcgtatttaacgttgaaaagattgatgaataactcttagcatgcactgattccataaattggatgttattcaaaacagcttcttcatgcggtgttctgatattggcttttaagctcgccataccatcttgtgattgcaacgtatcaagtaacgttaagccgccaaaaacatgacccacaatccatttttcattgtctggtaaactccgccagtcatctaaatcatttgaaaggggaattcgtgtatctaaccaaaattgttcggttagcttttcccaagtcgctttatcgatttgatcttcaacttgattccaattaattgcatgataattttctgtcatttagattacgcagctttcacatgcgtttgcgccgacttcgttttcgtcgtccgtatatgttcggatgtagtagattgatttaatgcctttatgatgcgcgtagtttctgaggatgttaagatcacgggtcgtcatcttatctgtgcgaccgtctttccagtcatataagccagctggaattgttgaacgcatgaagagtgtcatactcatcccttgatcaacgtgtttttgtgcagcagcatagatgtcgattactttacgcatatcgatgtcataggctgattcataaaaaggcatcgtttcatttgataggcctggtgctggatagtaaattgtcccaattttcttttcttggcgatcttcaacgcgattgacgattggttggagactagctgacgtatcgttaatatatgaaattgagccattaggcgcaacagcgagtctgttttggtgatataacccatcttgcataatcgcttctttcaaagcggcccagtctgcttgagttgggatgaagacaccatcgaacagtcctttgactttagccgtcttaggcgcccattcagtattcaggtattgatcaaagtaactaccatcagcatacttactgttttcaaagttgtcaaaagtaatcccacgttctttcgcaatcttatttgaagcaactaatgtccagtaattcaataacataaagtaattgcttgtaaagtcgattgattcttctgaaccgtacatcatttggttcttagcgaagtaggtatgcaagcccatgccgcctaagccgattgtgtgggctaattggttaccatgtgccacagaagggacaacatcgatatcagaatgatcagtcacataagttaatgaacggaccatcgtttcaattgaatggccaaaatcaggagaggtcatcatgttcggaatattagttgaacctaagttacagctaatatcagttcctaaaacgtcatattcttgacgattgttaatttgagaaggggtttgtacttgcaagacttcagaacaaaggttactcatgataattttaccgtcaattgggttggctttattagccgtatcgatattcacaatataagggtaacctgattcttgttggagcttgctaatttcattttctaaatcacgggctttaattttcgtcttcttaatcgcgtcgttagccactaagttgtcatattcggccgtaatatcgatgtatgagaaaggttggccgtattcacgttcaacactatatgggctgaagagatacatatcagcgtcttctttgactaattcatagtacttatctggcactgttaagccgagtgagagggtctttaaccgatatttttcgtccgcattttcttttttagcgcccaagaaagccacgacgtctggatggaaaacgttcagataaacaacaccagcgccttgacgttgccctaattgattggaataagagaatgaatcctctaataatttcataacaggtaaaacaccacttgcagcaccgtcgatgcctttgattggatcaccagcaccacgcaagttagacaagctaatcccgacgccaccaccaattcgtgataattgaagagcagagttgatggtccggccaattgaattcatatcatcagttgtttgtaataagaaacatgatactagttcaccacggcgtgaacgaccagcatttaagaaggtcggcgtcgctggttggtaacgttgatggatcatttcatcagcaacactcatcgcgagggtttcgtcaccatccgcaaaatagagcgcgttggtgaagacccggtctttaaagtcttctaagtaaaagccgttatcatttgttttaagagcgtattgcgcataaaacttataagctgccatgaaagatttaaaatgaaagtcttgatcgattaaatattgatttaagcgttccataaaatcgattgagtaggcctttagaaaatccgcttcgtaatagttttcagccaccatgtaatccaagcgatcttgtagtgatttaaaagtcaccatgttgggttgcacattttgttctaaaaaggcttctagtgcttcttgatccttttgaagggggatttgaccgttaaccggaatattgatttggttattcaattcataataagttacgttttcagttttaatctcttttaaagacatttaaaaggccaatttttgtaattcggctggtctaaaaccggagaaactttcaacaccgtcagcttcaagcacaggaactgcttggaaccctttttcttttaagtaatcaatatattgaggttcatcgttaatattatgttcgctaaaagtaatgttatgtgtttctaaaaaatgctttgtcatacggcattggggacagccgttcttcgtatatagtgtaatgttagccatttataaaattggtgataggagtcgtgaaaatttttgtttgaaacgtaaccacgcagattgttgagcaatcatctcatctgttaataataccgcgtttttgatatcttctaaataaatctgctcgagttgccgtgctaatttcggatcataaataaaagcattggcttcaaaattcaatttaaaactacgaatatccatattagccgaaccaatcgtactaatatgaccgtccatgacaactgttttggcgtgtaagaaaccgtcttgataagcgtaaatcttaacgccagcttcatgtaataactgactataatactgtgtggcccgataaataaaaggatgatccggcatgctaggggtcatgatccgcacatcgacaccagacattgctgctgtcgtgagggcatcgataatactatcgtcgggtaccaaataaggggtttgaatccataattttttcttagctgaactgatcatcttcaaataacccaacttgatttgttcgtctaatttatcaggcccgctcgaaacaatttgcatcgctgccgtgccgcggttggcttccgctgcaatcgggaagtggctttcagaataagttaaacgaattgcttcttcaacactggcattccaatccatcaaaaagcgtacttgaagcgccaaaaccgcattcccggtaatgcgcatgtgtgtatcacgccaattaccgaacttagcactacggccgagatattgatcaccaacgttaaaaccgccgatatacccaattgtgccatctaaaacgacgattttacggtgatctctaaaattcaaacgaaaatccgtgattgaatgtttcgaactaaagaaggtccgggcatgtccgccggcttcttcaagtggccgccaccatttttgggtggccccttgagaaccccaagcatcgtataagacgtttactgcgacaccttcctgggctttttgaaccaatagtgcttgtagttcattaccgatttgatcattgtaaatggtgtagtactcaatatgaatactcttagtcgcttttttaatatcggcgaacaaggcagcgaatttttcggtcccgtcagtatataacgttacgtgattatcctttaaaaccggtgcgttattaatgtttaagaaaagattgaccatttcagtcgcttcactggacaacacctttttaggtaataattcattacgccgattttcttgacgttgaatatcaactaaggccaaaaccccatcgttgatttgtgactgactttggaaaatctttttccgggataacccacgccctgtgaaaaggtacaaaataaagccgacgacaggcagtaagattaaaactagtagccacgcccaagtcgccgcaatatcgcgcggttgtcgtaagaccgtgatgaccgcaaagaggccgttaattaaaataattgcggaaataatctccgttagtagtatcatctatttttttaagccttgttgtgcgaggtggtgtgcccctttattttgccgatcaggcaaccactgatgtagcacgagggaatagggctgttctaaggcgataatctgatcaacatattgctggtaatgtttcgcatattgtttttcgaggctttgacagacaattttactatcaacattaatttgaagcatcgactcggtcaaaccaagcgtagtaattttttctaagcccaattgaaccgccataaactcggcaacatgattatccaccggcggtaagggaatgctaaattgatattgctgcttagcggtcacaatcagtatcccagcagcactggggccaggattgccaagcgtggctgcatctgtataaagtttaatcatttgcaaactaacaaacgcctattttaccagccaaactacgcctattgcgttacaatttggtcttggattggatttatttatacgctagctttaattctgcaacttgaactcattaatcttaattggcaatcgattacggtggggatcatcgcggttattttaaccattattaatctattcggtcatcgtctcgacatcactgcacagacgctaacgcttaaacgaccattatttaaatataaccgaacaattcaattggcacaaacgacagccgtgattgttcaaaaatacggcttattaattaagacaactgagcttgactatcaaccagagcaattattattatcggcgaaagttaaagaacaactaattaccacattagaagcaaataattggccagttcaaaatgaacagtaattaagcttcaattttttggacgttggccgcttgtaagccgcgggcgccttctttgacctcgaataagacttgatcatctttgtctagtgtcttatagccgtcaatttggattgcggtaaagtggacgaaaatttcctcatcatctcggtaattgatgaagccataacctttagcattgctaaaccatttcacgattcctcgttccatatgtcagatattcaaatcgcacaagcaaatgaagctacggaaatgaagcccatcacggcaattgccgaacaaatcgggttacaggtcaccgatattgaacaatatggcccttacaaagcaaaacttaactttcaagccatcaatcggttaaaagaaaaagaagatggcaaactcattttagtcacttcgattaatccgacaccagccggagaaggtaagtcaaccgttactgttggcctaggggatgctttacgccaacttgaccaatcagcagtcattgccttacgtgaaccttcattaggccctgtcatggggatgaaagggggcgcgactggtggtggttacgcccaagttgtgccaatggctgacattaatttacattttacaggcgatatgcacgccttaactgccgctgtaaataccctagcagccttaattgataatcatctacaacaagggaacgttttaaatatcgatcctagacggattatctggaaacgcgcacttgatattaacgatcgtgccttgcgccaagttgtgattggtttaggtggaccagtacaagggatgccaagacaagatggctttgatattaccgttgccagtgaattaatggcgattctttgtttagcaaccgacattaccgatctcaaaaaccggattagtaaaatcgtgattggctataactatgatcgcgaacctgtgactgttggcgacttagaagtcaccggggccatcgccatgttattaaaagacgcactcaaaccgaatatggtccaaaccttagaacacacaccagcactcgtgcatggtggcccatttgccaatattgcccacggctgtaatagtatcctagcgactcaaacagccttgaaattaggcgatatcgccattaccgaagctggttttggtgctgatttaggcgctgaaaaattcctcgatatcaaggtaccacaattaggtaaaacaccagataccatcgtgattgtagcgaccatccgtgccttgaagtataacggtggggtagccttggccgatttaaccactgaaaacttagatgccttgaaagctggtttcagtaatctagccaaacatattgcgaatatgcaacgctacggcgtccccgttgtcgtgtcagttaatgaatttacaagcgatacggctgccgaagtccaattgctacaagatctttgtcaagcaatgaatgtcactgcggtcccaactagtgtctgggccaatggtggtcaaggcgggattgaactagccaaagcagtcttagaagccttacaacaacctaaggccttcaaaccattatatgatccacaagctgacatcaaatctaagttaacaaccgttgtaaccgaaatttacggtggccgcgacgtcgtgttcgaaggcaaagcgatcaatcaactaaaacaaattgaaaaaaatggttgggctcacttaccggtctgcatcgccaaaacacaatattcattatcagatgatcctaaagcactcggtgcgccaagcgactttacaatccacgtccgtgaattgattccaaagctcggggccggttttatcgtcgcaatgactggcgccgtcttaacgatgcccggattacctaagaaaccagccgcactcaatatggatgttactgcagacggccaaattagtggcttattctaaatgctactttatattattttaggcctattaatcttggtgggtgatcaactcttaaaagggtggattgtcgccaatgttagctatggcgcgttgcacactgtgattcccaacattctcggccttacttacgtccaaaatgacggcgctgcttggagtatgttggctggtcagcaatggttcttctatattgttaccatcatcgcagtaggtgttattggctatttattttatacctctgaacgatctgaaaaactatatcgcatcggcttgacgttaatgttagccggcgcgttagggaatttcatagatcgtttacatttaaaatacgtggtcgatatgttccaattagaatttattaattttcccatctttaatgttgcagataccgccctcacttgtggtgtcatctgcgtctttattgccatcttgttgaaagagaaagtgactcatgactgaatgactgaaaaaaaagaatttacaattacaaccgaaaccggccggattgataaggtattaagccaattattacctgattattcgcgttcccaaatccaacaatggttaaaaaaggacctcgttgaaatcaacgggcaaacttctaaaggtaaccataaagtggtcgctgacgaaaagattagcgtcacgattccgaatcccgtctcactcgatttagtaccagaagatattcctttagacattgtctatgaagatgaccaagtccttgtggtcaataagccacaagggatggttgtgcatccttcaccaggccatcctaatgggactttggtgaatgctttattagcacatacaccactttctgaaatcaacggtgttttccgcccaggaatcgtgcatcgaattgataaggatacttccggtttattgatggtcgctaagactaacgaagcccacgaatcattatcagaacaattaaaggctaagtctaatctccgtgaatacctcgcattagtgcatggtaatatcgaagaagacgaaggcacaatcgatgcaccaattggtcgttcaaaactggatcggatgaaacaagcaattgtcccagacggtcgcccagcggtcactcattttgaagttgttgaacgctttacggattatactttaattcgttgtcgcttagaaacgggccggacacatcaaatccgtgtgcatcttgcttatattaaccgaccagtagccggcgacccaacttatggtcctcggaagacattgcctggtaaagggcaattcttacatgctgctgttttaggctttaagcacccaacaaccggtgaaaacatgcgttttgaagcgccattaccagccatttttgaaaaaacgttgcaggaattacgcgaaaacaattgaatggtgaaagaagtcgtagatagcacaacaatgaaacgtgtttttacacggattacttacgagattatcgaacaaaacaaggggatttcagaccttgtctttgtcggcatcaaaacacggggcgtttttatcgctgaacgcatcgctaaacgtttagaacaactcgaaggcgttacggtaccagtggggacacttgatattacactctaccgtgatgatcaacatgatttaaatagtcataatgaaccccaactaaatggtaatgacatccctgtcgatattacggacaaacacgttatcctcatcgatgatgtcttatatactggccggacaattcgggccgcgcttgatgccttaatggatcttggtcgccctaaaaaaatctcactcgctgttttagtcgatcgtggtcaccgcgaactaccaattcgacctgatttcgttggtaaaaacattccaactgctcttaacgaacaaattaaagtcgctatgcaagaaattgacgaacatgatggcattaccattgaaaaattgaattaaatgacaaaatcaacttaccgcaatcccgatgcggtgttagacgtaaacgagcgtccaacaaccgggaaatggattggcttatccatccagcacatgttcgccatgtttgggtcaaccgtcttagtgcccatcttggtcggcttaaaccccggtatcgcactctttagttccggggtcggcaccctgatgtacttattaattactaaaggaaagattccagcttacatgggctcgagtttctcattcatcgtcccaatgctcgctttaatgaaaacaactggttatcccgggattgcgcaagggacaatggctgtcggtgcggtttacctcatcgtttctgtcttagtaagtttaattggttccggctggatcgacaaagccttgccaccgattgttgtcggcccgattgtcatggtcatcggcctctcattagccggtacagccgctaaacaagcgacaatcaatgccgctggtaactatgacttgaaattcttcgcagtcgctatcttaaccttactaatcacaatcgcctttaacatgtatctcaaaggcttcatgagtttgattccggtcttactcgggattgtctcaggttacatcatcgccgtcttgttcggcatcgttgatttccaaccggtcttaaacgctccttggttcaaggtcccggatttccaagtgccatttgtcacctataaacccggtctttactggggcgcaatcctcagtatggcaccgattgcgtttgttacaatgacggaacacatgggccacatcatggtcttaaataaattaacgaaacgcaacttcttcaaaaatcctggtcttcaccggactttagcaggggacggaacagcttcaatcatcgccgcttttgttgggggccctcctgtcaccagttatggtgaaaacatcggcgtcttggccattactaaagttcacagtgtttgggtattaggcggcgccgcattttttgccatcatcttcggtttcatcggtaaactaagcgcactcatccaaagcatcccggcacctgttatcggcgggattagcttcttactcttcggcgttatcgcctcaagtgggctccgggtcttaatcgacaaccaagtcgatttcgataaaaaacggaacttaatgattggctcatcaatcttagtgattgggattgggaatgcctacttacaacttggtcaatatcaattctcaggcttagcgattgcaacggtcttaggcatcgcaatgaacctgatcttaccacaaaaatcaaagagtgaaatcgaattggaggcacaacaaaatgactaaatgactaatcaaacggcgattgtatctgttgaacaactaacaaattcatctgttttaaatttaattgaacgggcagaagcctttaaacaaggtgcgacttgcgaattaacgcgtcccgtatacgcgatgaacctcttttttgaaaatagcactcgaaccaaaacgagttttgaaatggctgaacgcaaactgggattatcagtaatgtcttttgaagccgaaaccagttcagtttcaaaaggagagacactcagcgatacccttaagacggtccaagcaatcggcgtcgattttgtcgctgttcgtcatccacaaaacaactactacgacgatttactcgccgatccagcctttcacttagccttggctaacggtggggatggcagtggtcaacatccatcacaatgtctactcgatatgatgaccattcatgaagagttcgggcacttcgacggtttgaaagtcgttatctgcggtgatttacgccactcacgagttgctaaatctaacatgcaacttttaaaacgactgggtgcacaactctacttcgccggtcctgaagaatggtttacggctgaattcaacgattacggtcaacacgtcgccctcgatagtatcttagatcaagtcgatgtggtcatgttactcagaattcaacacgaacgctttgattcagccgaaacaatgaccgacgaagccttccacgttaaatacggcctaacagcacaaagggccgcccaattaaaagcaagtactatctggttacacccagcaccagttaaccgcgacgttgaaatcgccgatgaattagtcgaagcaccccaatcacgaatttttaagcagatgcataacggggtcttcatgcgcatggcaatgattgaatacttattaaaacaaaaaaatctcattaaagattagatgtatcgacttatccaaaatggtcaactattaattgacgatcaactcgtcaaaagagacatcgcgattgatgaaaaaggacggatcactgcgattgaagcacaaattacaccaactgacgagccagccgaaaccatttttgatgcacaaggcgcacttgtaagtgccggattaattgatggacatgttcatttcagagatccaggtttcaccgataaagaaaccctccaaacaggcagtcgggctgcggcccacgggggttatacgagtgtcattgcaatgccgaacctcaacccagtgcctgacaatctacccgatttcaaaacattagttgctcgtaaccaaacggaaacaagcgtccatacgtatcaatttgcaccaatcaccggcgatttagtcaataacgacctagttgatatgccggctttcaaagcagcaggcgccgccggttttaccaatgacggtcacggtgtgcaagatgctcaaacaatgtacctcgccatgcaacaagcagcagcaattgatgcgccaatcgtcgcgcacgttgaagacatctcattagtcaacggcggtgtcattcacgacggtgccgcggctaaacggttaaacgttcctggcattcctagcgtgagcgaatccgcccaagtcgcacgtgatatcgaacttgctcgtgcaaccggcgttcactatcatatctgccacatttcaactaaagaaacagtggcgcttgtccgccgcgctaaagcagatggtgtcaatatcacctgtgaagtcacaccacatcatcttttactcgacgatcgttcaatcattagtgacgacgccatgttaaaaatgaatccccccctcagaacgttagcagatcgtcaaagcctctgggtaggtctgatggacggtacaatcgacgtgattgcgactgatcacgcaccacataccgcggctgagaaaagtcagtcgttattacaagcaccatttggtatagtagggagtgaaacagccttcagtttactctatacacacctggtcgttaatgggccctttagcttagcccaattattagctaaaatgacgaccgttccggcacaggttttcaatctaccagcagccggtcaactacgcgttggcgaccaagccgatatcgctgtttttaacctgacacaacccactactattcaagcaaccgactttcaatctaagggtcacaacacgccattcatcggtgaaacggtacttggcggtacagaattgaccctagttgccggtcaagttgcttatcaaaggagtaaatagatgaaacgttatctcatcttagaagacggcaccgtctttagcggttttggcttcggtgcacctacaatctcaaccggtgaaattgtctttaataccggtatgagtggttatcaagaaaccattacggatcaatcctacaacggccaaattattgcttttacatacccattaatcggcaattacggtgttaaccgcgatgattttgaatcaatcaaacctacttgtaaaggggtggtcgttcatgaagtcccacgcttagctaataactggcggatgaacatgagccttgacgacttcttaaaacaaaagaaaattcccggtatttggggcattgatacccgcgccttaacgcgtcgcttacgggataaaggtactatgaaggccagcatcgtggatgccgctgacgatcatgcctttgatcaattaaaagccttggtattacctaaaaatcaagttcaacaagtatcaacggctaaaccatatcctagtcctgcgaccggtcgcaatatcgtggttatcgactttggattgaagcacagtattttacgcgaattatcaaaacgcaactgtaatttaactgtcctaccttataatgccaccgctgaagagattctcagcctcgatccagacggcgtcatgttaaccaatggccctggggatccagaagatgttccagaagcaatcgaaatgattcggggcattcaagggaagctaccaatcttcgggatttgtcttggccaccaattattcgcactcgctaacggcgctaaaacatacaaaatgaagtttggtcaccgcggctttaaccatcccgttcgcgaaattgccactaaccggattgatttcacgtcacaaaatcacggtttcgccgttgacgcagactcaatcgacccacaacaactattagtgactcacgttgaaattaacgaccacactgtcgaaggactccgtcatcgtcagtacccagcattttccgttcagttccatccagacgcagcacctggtccacacgatgctgtccacctatttgatgaattcatcgacatgattgatgattttaatcgccgccaaaaatagatgccaaaaagaaccgatattcgtaaaattttagtcattggctccggtccaatcgtgattggtcaagctgccgaatttgattactcaggaacccaagcctgtcttgcacttaaagaagaagggtaccaagtggtgctcatcaactcaaaccctgcgacgattatgactgataaaacagttgctgacacggtttatatcgaaccaatcacacttgattttgtgacacaaattttaagaaaagaactaccagatgcgatcttaccaacacttgggggtcaaacaggcttaaacatggccttagaactcgctaattgtgggattcttgctgaactcgatatcgaattactcgggacaaaattaagtgccatcgatcaagctgaagatcgggagttattcaagaacttgatgaaccaactcaatgaacccatccctgaatcagccattgcgcactcattagatgatgcacaagaatttgtaaagcaaaacggcttccccgtaattattcgccctgccttcacacttggtgggacaggcggtgggattgccgaaaatgcaggccaactcaaaataatcgtcaaaaacgggattgcattatccccagttggtcaagtccttgttgaacaaagtattgcgggttacaaagaaatcgaatttgaagtgatgcgtgatcgcaacgacaacgccttagtcgtctgcaatatggaaaacttcgatccagtcggcatccataccggtgattcaatcgtctttgccccagttcaaacattaagtgaccgcgaagtgcaaatgcttcgggacgcttcattaaaaattatccgggccttgaagattgaagggggctgtaacgttcaattagcccttgatcctaacagcgagcgctacttcattatcgaagttaatcctcgggtgagtcgctcatcagccttagcctcaaaagcaacaggttatccgattgctaagatggccgctaaaattgcggttggtctaacactcgacgaaatctataacccaattaccgggactacttacgcgcaattcgaaccgatgttggattacgttgttgccaagattccccgctggccttttgataagttcaataagggtgaccgccaattaggcactcaaatgaaagcgactggcgaagttatggcgattggccggaacatcgaagaatcactcctaaaagccgttcgctcacttgaaatcggcacagcccaccttgaattagacggtttaaccagcgtcagcgacaacgatctggtccaacggattattcatccgcaagatgaccgccttttctacctcgcagaagcattacgtcgcgggtatctcattcaggaattagctgaattaacgaagatcgatttattcttcttagataaaatcagtcacatcgttgaactagaagaacaactccgtagtcaaaaaggcgacgtcgaattactcgaaattgttaagaaaaacggcttttcagacgaaaagattgccaaaacatggcaaatcacgccaatccaagtgcgccaaatgcgccaagaaagtggtattcaacccgtctataagatggtcgatacttgtgccgccgagtttgaatcacaaaccccttattactacgcaacctacgaacaagaaaatgaaagtttagtttcagctaaaccatcaatcttagttatcggttccggccccattcgaatcggtcaaggggttgaattcgattacgcaaccgtccactgtgtacaagccattcaaaaggccggttacgaagcaatcatcatgaatagtaatccagagacggtttcaactgatttttcaatctccgacaagctttactttgaaccattaacactcgaagatgttttaaacgtcgtcgaactagaaaaaccagaaggcgttatcgttcaattcggggggcaaacagcgattaacttggccgcaccacttgaagaaaacggcgttaaaatcttagggacgagcgttgccaacttagaccgcactgaagaccgtgatttattcgaccaattgattcaagaattgaatattccccaaccagtcggtaaaacagcaaccaacgcacctgatgcgttaacgatcgcaacagagattggttatcccgtcttaattcggcctagtttcgtcttaggtggccgggcaatggaaattgtgcatacgccagaagacttaactcactatatgcaagaagccgttaaggtctcagacgaacacccagtcttaatcgatcgttacttaatgggtaaagaatgtgaagtcgatgctatctgtgacggtcaagaggtcttaattccaggtatcatggaacatatcgaacgggccggtgtccattcaggcgattcaatggccgtttatccaccacaaaacctcacagaagatcaaaaagcagcaattatcgactacaccactaaactttgtcttgcactcgattgtcatggtttgttgaacatccaattcatcattcaaaatgacgaagtttacgtcatcgaagtcaatccgcgtgctagccggacagtgccattcttaagtaaagttactcaaattccaatggcacaactcgcaacccaattaattttaggcagtaccttagctgaattgaagagtccaacagggttgttaccagcaggcccactcatccacgtgaaagcaccagtcttctcattctcaaaactaacccgtgttgatagtctcttagggcctgaaatgaaatcaaccggtgaagtgatggggacagatgtcacgatgcaaaaagcactttataaagcctttgaagctagtggcatgcatctgccaagtcacggcaacgtcttaatgacagtcacgaaccaagataaggcccaagcacttgctttggcgaaacgctttagagaagttggttaccaaatcatcgcgaccccgggaacaacacaacaatttaaagcggcgggcattccagttcaacaagttgacaagatcaacgccacttcaggcgacttactcgacaagattaaagccggccatatccaactggtcatcaatacaactggtttaaacgaagccccccaagtggctaaagatagtattgtcattcgccaaaccgctattgaacacggcattccattattaacatctctcgatacaacggatgccatcttaacggtcctagaatcacaatcactcctcacaaaaccactctaaatgttgccactagaatggctgttaacgattcaagaccaaactgaaattgcgcctggtattttcgaactccgtttatcaggtgacttagcccaagaaaaggtgcaacccggacaattcgtcgatgttaaaattcctagcgatgcgctcctgttgagacgcccatttgggattgccaatgtcgatgccgcacataacaccattaccttactttatcggacggttggcgaagggacccaaattctcagtgagtgttcacagggaactgaattatccgtcttaggcccattaggcggacacggctatccaattgatcaacttaagcctcagcaaaaagctttaatcatcggtgggggaaccggcattccaccgttacacgaattatccagacaattagtcgctaaaggcgttcaagtccaacacgtttttggctttgctaatcaagaggccatcttttatcaagcggagtttgaaaaactagggccaaccgcctatgcaactaatgatggctcttacggttacaaaggtcacgtcggcttattactcgacgcgcaatttgcagatgccgccacaacctacgacgcaatctatgcctgtgggcctaaaggcttgttaatggctgtcgataatcgcttcagtgcacatccaaacgcttatatctcattagaagaacggatggcctgcggaattggtgcttgttacgcctgcgtcacgaaactaaaagtcgacccaacaatccagctaaaaatctgcgatgacggaccagtctttaaaacaaacgaggtgttaatctaaatgactagcgatttacacgtgtctttacccggcttagaactgaagaaccccattatgccagcatcaggctgttttggctttggccaagagtacggccggtattacgatcttaatttactcggcgcaattatcattaaagccgcgacaaaagaaccccgcttagggaatgccacgccaagagttgccgagacacccagtgggatgttaaacgcaatcggtttgcaaaacccagggattgaagccattatgactgaaaagctaccttggttggcagaacgttacccagacctaccaattatcgccaacgttgcgggaaataccgaagcagactatgtcgctgtctgtgaacgaattagccaagcaccgaacgttcatgcgattgaattaaacatctcttgccccaatgtcgcacacggcggcttagagttcggaacttcaccagaggccgccgcgactttaacgaaagcctgtgttgcagttagccaggtccccgtctacgtcaaactctcaccaaacgtcaccgacattcgaccgatagctaaggcagtcgaagcagcgggggcagctggcttctcactaatcaataccttagttgggatgcgtattgatccaaagacccggcaaccaatcctcgctaatcaaactggaggcctctcaggcccagccatcaagccagtcgcaatccgcctagttcatcaagtgcgttcgatttccaacctcccgattattgggatgggcggaatcgcaacagcgggggatgcactcgaactgatggcagctggtgctaacgcgattgctgttggcacggctaatttcagtgaaccatttgcttgtcccaatatcatcaaggcgctccctgatgaacttgctaagtacgatttacatgactttaaaacattcgccgttaaccaggaggttctataaatgacaaatcccgtaattatcgcgctagactttcccaattggcaaaaaacagaccaatttctacaacaatttcccaaagacgaagcactattcgtaaaaatcggcatggaacttttttatcaagaagggccgcagctcattaaaacgctcaaagcacgcggctatcggatcttcctcgatttaaagctttacgatattccaaatacagttcaaagtgcaatgacggttatcggtcaattaggcgtcgattacacgacgatacacgcagctggtgggcaaacaatgctgcaagccggtgccgctggcttaaaagcgggcgctaaacaagccaacgtcaaacccgccaagttattagccatcacgcaattaacgtcaaccaatgaggctcaaatgcaacaggaacaactcgtttctgtcagcctgcctgaatcggtggcacattacgcacaactcgcgcaacaatccgactgtgacggggtaatctgttctgcacaagagattactaccatcaaaagtaagaccgctacagattttctctgcgttacaccaggtattcgtcccgcaacgagccaaaataacgaccaaaaacgggcagtcacaccacttgcggccgctcagatgcatagtaacggcatcgttgttgggcgcccaattacgcaagccagtgatccttatcaagcttaccaagctatcaaatcagaatgggagtctttcaaatgaatgacaacaattgccgaacaagtcgcacaagccttaatcgatatcaaagcagtgagcctcagtccaaatcaaccctttacttgggcaagtggcctcaaaagtcccatttactgtgacaaccgcctcacaattggctaccctaaggtccgcaagttaattgccagtcaattagccgctgccatcaaagcccaattcccagaagttgaagtcattggtggcactgcaaccgctgggattccacatgctgcttggattgcagctgaacttgatctaccgatggtttatattcgctctaaaccaaaggaccacggtcaagggcgtcaaatcgaaggaccctttacagccggtcaaaaaatggtcttaattgatgatttaatttcaactggcggtagcgtactgcaagctgctcaagctgcacaaaaagaaggggctgaaatcctaggcgtctttgggattttctcatacgaattggctgctggtcgcaagaacttcgaacaagccgggttcccactgatgaccctttctaacttttcagcattattagccgttgaacaagctgccgataatctgacaccagaacaagcaacatccttaaatgaatggcgccaagatccacaagcctggtcagacgcacattaattaggcttgcactggtttattacgtaacttttgaacgagtgcttcgtccggtgtcgtatagagggtttgttgtccttcgtaaatgacaaaacctggtctggcaccgtttggtttcttaattttcttaacttgaatgtaatcaactggcacagcagctgataagcgggccttcgagaagtaggccgctaagttaccggcttcttgaatcgtttgttcagacggtgtcggactatcaataatcacatgggaacccggaatattcttaacatgcaaccagatatcggttttatgtgcttttttcaaggtcaactgatcattttgatagttattcttcccgacaaagattcgcgtgccatctgtcgcatagaaaacttctggttcactaatcttatagcgtttttgtttcttagcgcctgttttcttaatcttaagatagccttcagcctgtaattcggccttgatatcttccaaatccttaggttcagcgatctcaatttgggccataattgtgtagaaatattgtaattcagcttctgtcttagccatttggtcattcacataggcaatcgagtttcttagtttttgatatttcgagaagtacttctgtgcatttttggaaggactaatttgattggataacgtgattttaataggttcattgttatcgtaaaaattagggagcgtcacttcggtcatgccccgttcaacctggcgtaagtaggtggttaaaatttcacctttgatccgataatcatcggcactatcggctgctttaagcgttttttgtagttttttaagtttcttttcatccttttgaatctcattacgaatgaagtgaatgagggccccaccttgttgctgcacacggtcgcgctgagccttatgaagatagtattggtctaacagttcactcagcgtttcaaaatggctctgcgtccctgttaggctctgataagggaaggcggtaaaccatgatttcttttcaccaattgttaacgttggttgtgcttggtcaaattgcttgaagaaatcagtcacgactgctaaatagttatcgtggtccattaaacgggtttgcaattcaagggcgctttcgcggctcatgccttggaattgttgttgtaaccaatgaatttgttcatcggcatcttcattatagtaacttaaccaatcaagagttcctagatcggtcgtaaaggcatttagaccagttggtgctggtggattaacgtagtcggcccccggcattaaaaagcggaaccggttttgtgaaaccccaacatggcgaattaaatccaggattttttgagtttcaaggttaatcaagatgacattactatgccgacccattaattcgataatcaaacatagcttttgcatgtcgcccaattcgttacgggatttaaaggttagacgcaaaattcggtcactttcaacttgttcaatctgttctaaaatagcaccgtctaaatatttacgaagcgtcatcgcaaaatttggtggcgttgcagggttcgcataaggcacccgcgttacttgcactcgtgcataagaagggtgtgcagataacaaaagggggtatgttttacgattagcccggatggttaagattacctcattggcataaggctgttggattttagtaattttaccgtcggcaagcgttgtattgagctcgttgacaacggcgtgagtcattaaaccgtcaaaggtcatatgaaaattgctgtagtcactgatagtactgcttatctcacagaacagcaagtgaaagaccatcatctctacgttgttccgatcccagtaattctcgatggacaagtgtacgatgaaggcgtcgacattacatctgaagagttctatcaaaaattaaaaacagccgaaacatttccaagcacctcacagcctccactaggcgagatgttaaaattatacgaagatctaggcaacgaaggctacgatgccgtcatcagtatccaccttgccagcacgatctccggatttgtgacaactttgaaaaatgcggccagcaccatcgataatatccaagtcgtgccttacgattctgggattaccgtgatgttaatgggctatctagcaatggaagcagccagaatggcgcgcgatccagaagtcactgttgaacaaattacggcccgtcttgatgacttaagaagcacaattgatgaatgcttcatcgtcaacgacttacaaaacttagtccgtggtggccgtctatcaaatgcctctgcctttatcggtagcatgttaaagattaagccattattaacatttgatgacgaaaccaacaagattacagcttttgaaaaggtgcgttcattgaagaaggcctacgcccgcgctgaacaaatcttcgaagaaacacaagaacgtgttgactacccattacgggcattgattatccatgccaacgatgaagcggcagcactatcatggcgtgataaactccgtgaaaaacatcctgatttaccgattgatatcagctattttggcccagttatcggtgcccacttaggtgaaaaggcaattgccctagcttggattaaggatttcacgaaagaataattagccaatttcgactaattttgtaccaatgagtttataaataacagatttaacagctactttttgcacaatagccaacgacgattcgctgaggtcaaattcattgacgctggcaggcgcattaatattggccatttcatcgttaaaaagggccacaaattggtcataagcttcaccggcactagtattatctagggcttgttgaatgccttttttgcagacgtctagcgggaaaacaagcttcataatgctgacaataatcaattcagctagatgatcgcggttatagcgtttcttaattggccgttcaataatggccatcttaacgtaactgttaatcatcgttttcgtaatcttaacgtgcaagagtggctctagttgcttattgacttcattaatcacttgatccatatataactctagatccggaaaatctccccattgcggcaggcgcagggcttgaaagtcactaagccactgcttaaattcttgagattgcatttgcatatgatgactaataaacgacaacaaattatctacgaagtttggaatgccattacacacggtgtgggcttcttcggtagcctagcattggtaatcctcctgattgttaagagtgttcaaaaatcgctatccccagttgcgattgctagtttaatcgtttacggtgccacattactagcgctgtatctcgcatcaacgttattccactgtttagcctttacgaaggccaaacgagtttttcaaatattcgatcatagtaatattttcttgttaatcgctggcacctatacaccatactgtttgatttttatcgggcatacggcgggcattagtctattgattgcgatttggacacttgcaattgcgggcattttaacacatatttttagccacggtcgccaccaacgtctagaaaccagcatttacgttattatgggctggttatgcttattggcaggcaagacgttatacactaacttatcaccctcaggtttttggttgctcgtcagtggtggcgtcgtcttcacagttggcgccttaatctacagttttcctaaaattcctggattacatttgatttggcactttttcgtaatgcttggaacgacattaatgttcttttcaatttatctgaacatctaaatgacaattaaaatagtaaccgattcatcaattcaattaactacagcagaacaagaacggtatgatatccatattgtgcctttaacgattcaacaaggtgctgaatccttcgttgacggtcaaacaattacccgtgccgaatttttaagccgcttgcaaagtgcaacgactgagtttccaacaacgagccaaccaacagtcggcagtttcgttgaactatacgaccaattgggggctgatggcagtacaatcttatcaatccactgcacagggttactcagcgggactatcgaaggggcgcatacagcggcccaacaatcaacaagtgacgtccacgtcattgatagtaaagaaattgaccgtggcctggcttatcaagttgtcgcagccgctcaagatgttgaagcggggaagacactcactgaaatcattgcccatcttaatgaggttcgtagcaagacagaaacctacgtctttttagactcactagatgcactccaacgcggcggacgtattagccggatggcggggctcttaacaaaactgattaaactcaaggtgattgtccgcttaacagatacggaattagaagtgattgctaagggacgggggctaaagaccttcaccaaagaaatcaataatattcgcgaacacttggccactcaagatgttgctgaaattggcatttcacacgtcggcatcactgacgaactatccgccaaaatccaagcaacgctagaacaaacccaaccccacgtcccttatacagtcgctttaacgagtcccgttattatgagtcacgttggtctgggggccttcggggttttttaccttacgaaatagatgcgcacgaaagaatttgaaacaacagccgtcttagacaaagcaatgctcgttttttggcgccagggatatgaacaaacgtcgatgcaaaacctagtcgacgaaatgggcatccatcgtcgtagtatttatgatacgtttggtgataagcaccagctatttatcgcagtcttagcgcattatcacgatcaaatcaccgcgacatttaatcaaatcatcaatgattatagcgaccttagtagtcgtttgacagccatttttgaggcgttcattaaccacccggcacaacaaccagacggctgtttagtcgttaatacggcaaccgcgttatcaacgttagaagaagatatccaacaacttattaaacgctatttacagcaggaacaagcaatgctgcagcgattactgattgaagggcaagctgagttgcagcctcctattaagagcgagctattagccgcaacacttcaaaatgcattggttggcattcgtgtcatggctaaagtaaatccagattcagaggcgctaatcgtaacagcacaccaaacacttcaaatactcccatggaaagaggcactttaaatgaaagcagctcaaattacaaaatatagtaaagatctcaatgtgaccgtgaaagaaattgccacccctaagccccaagctaacgaagtactcatcaaagttagctatgccgcagtcaatccgttagatttaatgaatattcacggcagtgttaagttgattcaagactattcgatgccattaacccttggcaatgaagtcgttggtgaaattaccgctatcggttctaacgtaacgccttttaaaccgggtgacctagtttacacacgtctaccacttgctaagattggtggttttgcagaatacgttgcggtcgatgccaatgctatctggtatacacctaccaatttatcagctaaagaggccgttgctgtccccttgaccggtttaaccgcttatcaaggcctcacggaagaattagctgttgaagcagggaagacgattttcattcctggtggttctggcagttttggtcaattagccgtgccagtcgctaaatctttaggcttaacagtcattgtctcagggaacgctgcagcacgtgagcatattctagaattaggtgctgaccaataccttgattaccggacaaccgattattggcaggtattaaacgatgtcgattacgttatcgatactcgtggggctcaagatatcgaacgtgaactttcaattatgaaacccggtggccgtttattaagtttggtggcaggtcctaataagcattttgctatcacgcaccaattacctgcctggaaacgacttttatttggtttagtcggtaagaagtgggataaactcgctagtaaagctcaagttaactaccgcttcatctttgtgcgttcggatggccaacaacttaaaaaagtcactgaattagttgaaaaacatcacattacaccagctatcgatccacacgattttgatcttgatcacgttcaagatgcactggaattagttgctaatggtaaattagccggtaaagttgtaattcgactaactgactaaatggaccaacaacgttatctcgaactatgtgaacaacgcttggcggatcttcccgattacgtccgtaaattttatattaatcggcaagccaatgcatactcctctgcaacgctctatcaatatctccaagaatacgtccgcttcttctcctggttaattgacgaacaaatcgttactgttcaaacgactaaggatatccctcttgttgcgcttgataagatgaaattagaagatatcgaactctataagatctttttaatgaataaacgaaaagcaaataatcacaagctctcctttcaggctgttaatcgctctatcaacgctttgaatgcgctctggtacttcctgacgattgaagccgaacaagccgatggtgagccttatttctaccgcaacgtcatgaaaaaagtcaaactgctcaaatcatccgagacaatggccactcgttcccgccatatcggtcaaaagttgctcaccggtgataaaaaacacgacttcattgcctttatgcaagtcgactatcccagtgcgctatctaatcgccaactcgcttcttatacgcagaattgtgaacgggatattgcgatttgcgtattggcactcactaccggcattcgtctttccgaactcgcccaagctaacgtttctgatttaaaccttgaacaactaacaattacggttattcgcaaaggcggtcaacaagataccgtgccgatcgcaccttggggtttaccttatctgcaagattacgttcaaatccggcaacaacgctatttagccgctaacgaacgggccttatttgtcacaaagtatcgcggtcaagcgaagcgaatcagtaactatgccattgaaaaactggtagctaagtactctgaagcttttggcgttcgactaacgccgcataaattccgtcatacactcgcaaccgatctgatgtcagcgacccacagcgaaacgatcgtagcgacccaattgggccaaaccaccacgcaggccacccatttgtatacgcacgtggttgatgacgaacagcgctcggcaatggataagctcgaatgaatgcaacatcaacggttattgattcaaattgaaggggccattatcgcggcatttgcgatggctctggaatatattccgcatactgtagggccatcagcgattgaggtttcctttgggattatccccattattatctatagtctccgtcgcggcgccgcggctgggatggtttcgggtttaatctggggccttttagacctcgtcttacgaggcctcggcaacgggagcgttctcaatgtttggcaaggattacttgaatttacgattgccttcatggtcgttggcctagctggcgttttacaaaaaccagttcaagcaagtatccaacaaaataccaaagtaaaaacgattgcgctcctttggtccgcagctttcattggtactttcgccaaatacttctgccacttcttagctggggccatctactggggctcatacgcgcctaaaggaatgaatgcttggctctattcattaactgtgaatggcggtagtttcgttgccggcttcatcttaaatggtatcgtctttgggattttattagcgatgattccgaaactatacctcccaaaagatatgtttttaaaagtgcaatctgaagaatagttaatggtcatttctagcacgtaatgcgtataaaatcgaaactgtgtcgacaacttcttggaataaggccccaattaaagctggcacgacaccggtactggcaatcaacatcaatccgatacagatgaagatcccaatcaaaacggactggcgcgccacccgcattgtatcccgtgcaatcgtgatggcgccactaacccgactcaaatcatcctttaaaatgacgacatctgcggattcgctcgctgctgtggcaccgtgagcacccatcgcaattccgacatcggcactcgctaaggatggtgcgtcgttaacaccatcgccaaccatgattatcggccgctgctccggcgtgacattattgatgagtcgaatcttatcggcaggcaaacacccagcgtgaacttcatcaatgccaacttgagccgcaatctctttagcggttgtcgcctgatcccctgtgagcatcattaagcgctgtaaaccgagctgatggagcgttgacatcgtttgaggcgcttcctggcgaagatggtcgataaatgtgatatagcccgcataacgcccgtcaatgccaatgtagacagttgtctgtgtctgggattgtttagcttggtcaggcgccacaaattcaaatttaccgacttgaaccgtctgtccagatgctaattgggcagtcacaccagcacctgtcatttcttttaaactaataatttctaataattgcgctgctgggacgacttgtagtaaggaacgagccagaatatgggccgaagcctgttcagcactggctgctaaacgacataactccgatggttcaatattaatcatcggtacaacttgatccacggttaattggccattcgtaatcgtgcctgttttatcaaaagcagctgatttggccaacgccaatttttcaattgtcgtccccgttttgacgataatcccattccggctggcacgactcatacctgagataagcgcaatcggtgccgcgagaatcaacgggcatggcgacgcgaccaccaagacctcggcaaagcgcacagggtcttttgagagccaccatgccacccctgcaatcaaatacgccactaatgtaaatggtacggcatagcgatccgctaaacgaacaaaatgggcaggttgtgctgctgagctttcaaccagtttaacaattgcttgatactgactgttaatagctaattgatcgaccaccatcgtgattgatgtctcaccatttactgaccctgacataattggctcattgattgttctttcaactgggcgtgattcaccggttagagacgattcatcaaacagcgatgacccctcaatgatatgaccgtcaaccggaaccagttctcctggcttcacaacaacttgatcattgacttggagttcgtcgacagcaacatcgacaagtccgtcaccacgcattaaatgcgcgacctggggcgagttgtccaataatgattttaattcccgccctgctttatgcgcggcgtaatcttccagggaatcgccgcctgttaacattacgaggaccatcaaggcagcccaatattcaccaacagcgagtgttgcaatgatcgccgtaatggctagtaaatcaacaccatatcgacctgattttaaagtgcgaatcatctcaatcagcatcgataacgcgactaaccccccagctagactaactaatacttgggcccacagtggttgttgacataaaaaggctaatattaatgcggtaatcccaaccacaattgtgagcactaatttcaacgtatgtttcatcatttattgatgggtctcatttacagaaagttgtgccataatagctgtccgaatggatgtcattgctactattaatgttgtcatccgcttaattacaggcgatgtctttttttggttagccaacgctttttcggttttatggatgattgactcaatcggtgcctgtgccctgaccaatgcttcagcagttatatctgtgcgcccattcaataaatcacgaccaacttccaatgcgtgaattctattttttaataaagtaaattgggcggacccttctccaaattttagctggctcttttgacaatttcgaattgtcgcttcaatcacttgaattgcctttgttacttcctcagtcatttaaaatgctgctgttaattgtgggacaacttgtttcttacgtgacacaacaccggctaattgcgcacgatggttgtttaaggtcacatcaaaagccttttcgaaggcttcagctggttcgccgataacaagcgcttctgagttactgtttaagatgtcagtaaccaaaagtacgaataagtcgtaaccgttagctttgttgtctgcttcgatagcagcttcaaaagcagcttggcgtttgaagaccgcttcgatatcaactgtgttaacttgatcgatacgaacttttttaccagccatatcgaatgttttagcatcagcttcaattaattcagcttcgctcttatcatctaagttagtaccagcttttaacatttcaagaccatatgattcaaaatcaacatctgcaatttctgctaatgtcttgatagcaatccgatctttttcagttgttgttggtgatttcatcaacaatgtatctgaaatgatggcactcatcattaaaccagctaattgtgcagggatttcaattttattttcgttgaacattgataaaagaattgtgctggtacagccaactggttcagcacggtagaataatgggcttactgtttcaaagttagcgatccgatgatgatcaacaacatcagttactgttaaatctttgatatcagcaacactttgttgtgcttcgttgtggtcaactagcataacactttgcacttcactaccggcttctttaatcacacgtggtgtgcttgcagcaaagtgacgtaatgcataacttgtttcttcatttggttcgcctaaagcaacagcttcgacatccttgccaagttgttgttgtagataagcaaacgccattgccgcaacaattgcgtctgtatctgggttttggtgaccgaaaactaattctttactcatttagataattttacgattttgttccttaattcgcgttaaatagtctttttcttctagataaaggttaaattctcggaagaaactgtcaatccgaggaatatcttccttttctttacggaatacaaaggccaattcaaattgaattgctggatcaaattgcaccgcgttcgattcaataccaacattatgggcatcgtaaaaactcttaggcaatgcagtgcttaacccagttgcttcagcaaaccgtaaaatttcaaatggtgatgtaaattgggctgcactgactggccgatctaccatttgattcttataagcttcactgatgaattggttgagatagtattcatcggggtatgttacccatttttcagttaatgtatcctcaaaatgaatcttcttgcgtttcttcaataatggattattactcaagaaaacaaggctttcatccgcaatcttcttggaacggtaaggcttccaatttttgatactgtcatctggcaaatacatgattgcaagatcaattttattattttcgagacggtcccaaatttccttacgtgtcaataaatgaacactgacttcgatattggggaattgttggtaatacttgattaagaaactttgaataacactgagttccatcgatgctagaatcccaatattaattttaccacggctagcgctagttgcactttggatttcatccgttgccgtatttaataaatcgtaaatttgatgagtggcatctaacattgtccgaccggcatcagaaatgtgtaatttcttaccgacagaataaaaaagtggtgccccaactgtgcgttccaatttcttaatttgttgcgttaatgcaggttgtgtaatccctaatagctgagcggcctgcgtatagttcatcgtttccgctaattgcaaaaaataagttaacgttttagaagaaaatatattctcttgtctcgtcttcatttattttgaataatcagctgtatgcaaaagccgttctgcattaacaacccgatcatgagttggtggctcgatgccttcaagtgggtacttaatccccattttctcatatttgacaatccccattgtatgatatggcaacacctcaacccggtcaacattattcaatgtcttaatgtaatcgccaagtcgttctaagtaacaatcataatcagtccgttcaggaattaagacgtgacgaatccacatatgatgaccatgattagacatatattcgatcatttctaaaatatgtttatttgaaaaaccagttaacttcttatgaccttctggatcgatatgtttaatatcaaccatcgatagatccgtatatttcatcaattctttaaacttactgaaaaatggttccttatacgtgaaaggttgcccacacgtatcaagacacgtattaatgccctgtgctttgcattttttaaataaatcaattaagaaatcaatttgaatcagtgattcaccaccgctacaagtgatgccaccttccttaccccagaaagctttgtacggtaatgcttttgcaattaattcgtcagcagtatacggttcaccactaccaatattccaagtatcgggattatgacagaattcgcaccgcatgcgacacccttgtaaaaaggccacaaaacgaataccagggccatctacggatccaaaagattcgattgaatggacatagccaattggtgcttctgtggtttcttctggtacgactgtttctgcggtttccgttgataaacgggttgtaaatttaattgccatctacatttcatcgaagaatgttcttgaaataacatcatcttgttgttccttagttaaatctgcgaagtagacacagtaaccagaaacacgaactgttaatgttgggtattcttcaggatgttgttgtgcatccattaatgtttgtttgttgaagacgttgatgttcaaatgcataccgtggttaaccatgtaaccgtcgaccatgttaactaaggcatctttacgtgcattgtcatcatgacctaaagtattaggtgtgacaccaaatgtatttgaaatcccgtcagttgcataacgataaggaatcttagctgttgaaagtaatgatgctaaagcaccgttcttttcagcaccgtatgctgggttagcaccaggtgagaatggttcgccggcttgacggccattaggtgttgtccctgtattcttaccataaacaacgtttgatgtgattgttaaaacagatgttgatagttttgagccacgatataagtgatgtgtgttcatcttgttgtagaaagtcttaactaaccatttagcgatatcatcagcacgatcatcattattaccataacgtgggtagtcaggattttgtgcttcaaaatcgactgccataccgtcttcgtcacgaataattttaacttgaccatatttaatagctgaaattgaatcaaccgcatgtgataaaccagagataccagtagcaaatgtccggtctaagcgactattcttcaatgctaattgtgctgattcatagtaatacttgtcatgcatgtagtggattgtgtttaaagcattaacgtaaacgtctgctaaccaatctaacatcttatcgtatttacccatgaattctttgtaatcgatgatttcacttgtgattggttggtaagctggcccaacttgtgctttacctaattcatcaatcccaccgttaattgcgtaaaggattgtcttagccaagttagcgcgagcaccaaagtattgaacgccatctgcgattggttgtgcagaaacacaacaagcaatcccataatagtcgctaccccattcgttgcgcatcaagtcatcattttcatattgaattgttgaactcttgattgacacttcagttgcataacgcttgaaaccttctggtaagcgatctgaccaaagtaacgtgatattaggttctggtgcagcacccatgttttccaatgtcttcaagacacggaaggcagtcttagtaacatggtgacgaccacccataccaatcccacacattgataatgttgcccagattggatcacctgagaacaatgagttgtagtcttctgtccgaatgaaacgcaccatccgtaatttcatgacaaaatgatcaaccatttcttgtgcttcagcttctgtgatcaagccgcgatctaaatcacgttggataaagatatccattgttgtatcaatccggccaactgacatcgcagccccgttttgagtcttgatagctgctaagtaaccgaagtagatccattgaacggcttcttgtgcgttcttagcgggtcttgaaatatcaaaaccatagctagcagccattttcttcatgtcttgtaaggcacgatattgttcattaatttcttcgcgaagttgaataactgaatctgtcatttcaccgtcgccaacaccgttaaagtcacgtactttttcttctgctaagcggtcaatcccatagacagcaatccgaggtaaatcagggataatccggccacgtgcataagcatcaggaagacctgtaataatcttgtagtgacgtgctttacgcatatctggtgtataagcatcgaaaaccccttggttatgagttttacgatattcgctaaagattttgtgttgttctggatctgtcttaaagccataagcttctaaggcatcttcagccatccgaatcccaccaaatggcatgaatgcccgtttgagtggtgcgtcagtttgtaaaccaacgattttttcaagatccttatttaaataaccagggccgtgtgatgtgacagttgcaggattgtcgttatcagcatctaaaacaccgcctgcttcacgttcttttttcttaagtgccattaattggtcgtttaaagtggttgtcgcttcagtaggaccagctaagaaactttcatcaccatcataggctgtgaagttttgttggatgaaatcgcgaatatcaatttcatcttgccaatcacccttattaaaaccgtcccaataatcggctaaattgattttttcagtttttaccatttaatctttatggtttgaaattggttcgctggattgtgctaaaacaaataccggttgaccaacttcttcaacatccatgacgaagctcccgtttgaataacggtcacctgttgcatgcgcttgtggttcaattgttaataatgcctgttcggttttcactaataatgtgatcttaggtgcgactctaatcatagctgccacccgatgcggatcacgttttagttcacgtaggattaagaccccacgccgagcacggcttgttaagccaatttcgcttaagaacatgcgtttaaaggccccacgttgcgtgataattgccacagcagcgtgtttttcggttggatcaaagagcgtaaagttagcgacgtgatcgccatctttaaggtccatcagtttcacacccccggctttggcaccagagactgatacttcgttcaaggcaaaactgagcccgtaaccgttataactagcgctaaagacggcctgttgttgggcatctgtttcagagacccaataaacattcgtcacgttcgcaccagcatgcagtttgataaagtcttgggcttttgaacgataagttcgacttggcaataagtcttggaaagctgtttgcttaatataaccatctgtcgtcccaatgacaaaataaccattttgctcgtttggtgtaaagctaaaggccgcaataatcgcttcatcagctgctaagccaattgattgcgaaatatgttcgcccatttctttccacttcaaatcggcaatttcatgcactggtcgttgaatcagatgaccagagttggtaaataacatcaattgatcgagtgtctgcattggcttttgtaagatggcaaaatcgccttctttcagaccaccgtcagctccttctgaggcttgataagaacggaggctactccgtttaaggtagccatcatgactaaccgcaaccatgacagtttcatcaatcacagtcacactcgtatcaatctcaagggtttcaatttcggcttcaatttctgtcttccgatcgttccggtaagctttaaccaccgattttaattcagacttaatgacccgtgcaagttctttaggatttcccaaaatagcttggtagccttcaacagctgtttttaattcagcagcttcggcttccaaggcagtcacatcggtattcgttaaacgatacaattgcaaggaaacaattgcttcggcttgtgcttcagtaaaatcatactgtgccaccaaattcgtcttagcgtcttttttattcttacttgcccgaatcgtactgattacttggtcaagaatcgataaggctttaacaagaccagcaacaatatgcaaacgatcttgtgctttttgtaagctgtattgtgtccgccgcgtaacgacttcttcttgatgtttcaagtacgcgtgcaaaatttcaagtaagccaacttgtttaggttgcatatcagagatagcaaccatattgaaattatacgtaatttgtaaatcagtattcttgaagaggtagtttaaaatcccttggctatcagcttgttttttcaattcgatgaccactgacaagcccatccgatcactttcatcacggacttcagaaataccgtcaaccttcttcaagacccgtaattcatcaatctttttgaccatttgggccttattgacttcatatggaatctcgctgacgacgatttgttcccgattaccgcgtaattgttgaatgctagttttagcccgcacaacaacgcgaccacggcccgtttcgtaagccttcttaatcccgtcaaggccttgtagaatccccccagtcgggaaatccgggcctttaacaaaggtcatcattttttctagcgttgcgtctggatgatcgattaaataaactaacccatctgtgacttcacctaagttatggggtggaatctcggttgcataaccagccgaaataccagttgccccgttgaccaagaggttcgggaagcgggctggtaaaacagttggttcttcagccgtatcatcaaagttcaggacaaaatcaaccgtctttttatcgatgtcttttagcatctcactggcaattttgctgagtcgggcttccgtataacgcatagcagctggtggatcaccatccatcgaaccgttattcccatgcatttcaattaatggttcccgtaatttccagtcttggcttaggcggaccattgcttcataaatcgagctatcaccatgcggatgaaaattacccatgacgttcccgacagacttcgctgatttacggaatcctttgtcataagtattgccatcaattgccattgcgtacaaaattcgccgttgaacgggttttaaaccatcccgaatgtccggtaatgcccgttcctgaatgatgtatttggaataccggccaaagcggtcgcccatgacttcttcaagggttaactcttgaattttttgtgcttcatcagccaattattctactgcgttatcgtcggagactggtgttgctgtttgccccgttgtctctaaaatgctgccttcttcagcgagcgtgaatttcacattttcttcaatccacttccgccgcggttcaactttatcacccatcaaggttgtcacccggcgttctgccaaagcagcatcgtcaatccgaacacgaattaaggtccgacttgatggatccatcgttgtatcccagagttgatcggcattcatttcacccaaccctttaaaccgttgttggctataacccttacccatatccttagcgacaacttttaattcatcgtccgtccaagcataggcaatcttcgttttagcaccggcgcctttttgaagcttgtacaaaggtggtaaggcgatatacactttaccggcttcgattaatggtcgcatgtaacgatagaagaaggttaagagtaagatttgaatatgagcgccatcggtatccgcatcggtcatgataataatcttatcgtaattgctatcttcaattttgaattcagcgccgacaccggccccgattgtatagatcatcgtattaatttcttcgttttttagaatttcttgtaattttgccttttgggtattcaatactttcccacgtaatggcaagattgcttggaacttccgatcacggccttgtttagctgaaccaccagcggaatccccttcgaccaagtacaattcatttttggccgcgttcttagattgtgcaggtgtcaacttaccagagagtaagccgtctgattttttctttttcttaccgtttcggctttgttcacgcgctttacgggctgcctcacgggcttcacgggccttgagtgactttctaaccaatgcttgggcgaattccccattctctagtaaaaagaagctcatttgctcataaacgaggttgtcgaccgcggttctagcctgtggtgagcctaacttacctttggtctgaccttcaaattgtagtagttcttctgggatccgtacagataagacggcactgagtccttcacgaacatctgagccttccatgttcttatcccgttcttttagcaaattaaccttgcgcgcataatcgttaaacgccttagttaacccagccttcatcccggcttcatgcgtaccaccatcaccagtccgcacgttattaacaaatgacatgatgttttcggaatagccgtcattgtattgaccagcgaattcaacttcgatgtcttctttggtgccttcaaaatagagtttattgccaatcgtgtctttatcctcgtttagataatcaacgaatgattgaatcccctctggataatgaaagacatcttccttagcaggatcagcacgtaagtccgttaacgtaatcttaacgtcttttaataaaaaggctgattcccgtaaccgttctgctaacgtattgtaattatacgttgtgacttggaaaattgatgcatccggtttaaaagtaatcagtgtcccgttaggttcgttagctttaccaaccttttttaaagtgccgactggatggccgccgttttcaaagcgttcttcataggcaacgccgtctcgaacaacccggacggttaaccattcagataacgcattaacgacactggccccaacaccatgtaatcccccagatgttttgtaactattctgggtgaacttaccaccagcatggaggaccgttaagatgacttcaatcgttggaatgcctgattgatgcatcccagttggcattccccgtccatgatcacgaacactaatactattgtccgcaccgattgtgacgttaatttctgcaccaaaacctgctagtgcttcatcgactgcattgtcgacaatttcgtatactaaatgatgtaacccacgcccatcggttgagccaatatacatgccaggccgttttcgaactgcttccaagccctctaagacttgaatcgaattatcattataatcttgtttttgatttggcatatgaaattaagtcttatttttatcttggcctacctgattggctcgtttccctcaggcgtcattatcggtcgggtcttttgtcataaagatccccgtgatgctggcagtcataatattggaacaaccaattcttaccgggtattaggcccaatcgctgggacggccgttttgttcctcgatattttaaaaggtactttagcagccagtctaccgataatttttcacatccctaatcattcattggtcttagtcgttggtttagccgcggttgttggccatgcctactctatctttttacgctttacagggggcaaagccgtcgcaactagcgctgggatcttactggcctacaatccgcttttcttcgtgattgctagtaccattttcattagtgtcattttaatcacaagtatggtcagcatggccagcattatcggtcccttactgattgccatcttgtcattttacacacacgactggttactcggtacgattgcgacgttagtcctaatctttttaacctaccgccatcgcgagaatatcggtcgcattaaaaatggtacggaaaacctagtcccattcgggttatattaccgctataaacaaaaaaaacgccaataattaaagatcgattaattgttctcggtcattataaaatgaatgataggctaagtagcaggcaatgactgaaccaagactcgtcgccgataatagcatgaatgttactaatatttggtacatgatggctttaaccggatcaacgccggcaaagattaaccccgacatcatccctgggagactgaccagaccgaccgtcttggctgaatcgatagtcggtgacatccccgtcttgatactctctctcacaattgcaattgaggcttgtttcaagctagcgccgagtgctaagcgttctaacacagcttggcgttgatccttaaattgcgtcaacatactccgataacttaggccgatggcgaccatcgagttagaggcaatcatccccgtaattgggataatctgtgagggcacgaatttaattgcaccggacaggactaataacccgagcgtgacacccgtactcgttaaaatggcgattaatgaaatgctaaacgcgtgtcgtaacgtactagcgcgtttacgcgcattagccgccgcgttaaagataatgatcaacatcatcgctagcgttatccagacatggttaatttgaaaaataaatttcaataaataacccacgataatcaattggacaatcgcccgcccgacactgattagcatatccttttcgagaccaattttttcgtggaaactaatgattaaagcgacaaagactaacgaaacagcaaaagttagtgataacccgttaacggctagattcatctgcatttaacggctagattcatctgcatgtaccaaacaaccagccacaatttgaagctgacgccctttccgttgttgttcttgtgtatcatgggtaatcgataaaaccgtaatcccatcttcttgattcaattgcgtaatcaacccattaacctgcgctttagtctgttcatctagtccagtcgtaatttcatccagtagcaggatctccggtttaaacattaggttgcgaattaaagcaatccgttgtttttcaccgcctgagagcgtcgtaatcttcttagtcaacggcatgtcggctaatcccactcgggctaattgcgtcttaactaacgtctcatccaccggtaattcgcgaatttcaaacgggaatactagattatcaccaactgactccccaaataacgttggttgttggaaacaataagacacgcgttgccgatattgcgtcggtttaaaatcggtaatcgactgacctgccaacaagatctccccactcgttggtgtcaataaatcggctaatagccgcagtaacgtactcttaccactcccagatggccccacaatcgtattgtaagacccttgttcaatcgcgatgttaatatcgctcagtattgattggccatcaacgctataattaaggcctttcgtctctaactgaagcatatgttaaacagctttccccaagtcatgacaatcgccggttccgactctgatggtagtgctggcgcccaagctgatttaaataccttcttcgcacgcggtgtttatggcatgagtgtcctaaccgcctgtgtcgctggtaactcatttgggattcacgcgagccaagcgctaacccccgagtttatcaacgccgaatttgaagcaatcgccgcagactttaaggtccgagcttgcaagacagggatgctcaccgatagtgagacaattatgacagttgccaagcagctcaagcaacacgattttggccccttggtcttggatcccgtcattattacaaaacacggcgcactattgcttgctgatgaagcctaccagacgctaaaaaccgaattgattccaatggcgaccgttttaacgccgaatttctatgaagctcaaaaattaaccggtattaccttaaatgaaccggccgatttccaagctgctgctgaaaagctactggcaatgggtgctaagaatgtgatgatcaaaggccaccacgctgccggtcaatcaatcgttacggattacgttcgactagctgatggtcaagaattctggttatcagaaccctatatcgaaacgacccacattaacggtacgggcgattcactttcttcatgtatctgtgctgaaatcgctaagggacattcgattgaagacgccattaaaacggctaaaaaattcgtgcacgccgctattgctaatccaatcgacgtcggccacaaatatggtcccatcaatcatcacgcgcaataattagtgttctgcttcttcaatatcggcgttaattgccttcaaatcgaaatcactgtttaaaaagtcagtatcttgacttggaaaatgttgctcaaacgtctcaaatggttgcacggttaattgggcgtcttcaatcacataatctaagacgtggcccccaaaatcgtgcgccgtgtttaagaagtgcacgtgataacccgcaactgcggccccttgatagagcgttggtgcgtagtaaccaactaacgtgccagtcacaccatcttgctcaaactcgggctgcacgcgcgttgcatccgtcaaattgggatagggttcttgttgggcctcaacggcacgcgtatgcatcttcttaaagcgaccggttaccttaacggcaaagaagaggttcttcaatggctgttgtgctaaaatctgcgcttcaagttccgccttagtcactgttccgagtgtttggctcggtagctcaggtgcttggaaatgaactgtcgcaaagggcaccatgtcagtaggcgcaagttgattaacccggccttcaccagtcacttggtaggcttgaccatccaagataatcatttcacctgctaagccatgcgccgtgccgatgccaaaatcaccatgggttaataaatcggcaaccgacaaagtcccggtaaataaaccgggtaccaatagtgccaatgtaccgtgttgataaacgcgttgataatcaaatgtcatctaaacgagttgatctggtaataaggcttgaccaagtagcttattatcactgtaatcgactggaatatcgacaatgactgggccttcagttgcaaaagcttggtctaggactttacctagatcggctgctttttcaacacgtaagccagtagcgccgaagctttcagcatatttgacgaaatcaactgggccaaattgaacggctgctgattcgccatatttcatttcttcttggaacttaaccatgtcatagtaaccatcattccagatgatatgcacgatatttaagttcaaacgaacggctgtttctaaatcttggcttgagaataagaagccaccatcaccggaaactgagacgatttgcgtattaggacggactaaagcagcactaatggcccatggtaaagcgacgcctaatgtttgcatcccgttactaaagagtaaatgacggggttcgtaacttctaaagtggcgtgccatccagatataatgactcccgacatcgaccgtgactgtcatttcatcagtcacgcgttcttgcaactcagacacaatattcaatggatgattaagtgtcttatcggctgacatttcaggtgctgtatcccgttggtgtaattctgcgtggagttctttgaggtagtcacgaacatcatcggctaattgatagcccttcatgtatggtaataagaaatcgagcgtttgtgcgatatccccaactaattccttttcaggttggaaattatgatcgatttcggcacgcatatcatcgatgaccatgatgtgcgcatcactttcggcattccagttacgcggttcgtattcaattggatcatagccaatcgcaattaccagatcactgcgttttaagatccgatcgcctggttgattacggaataagcctacacgaccgtaaaaatcagtttctaattcacgtgagacaaccccagcggcttggaaagtttcaacgactggaatatgtgtttcggcaattagattccgaatagcagctgttacttctggtgaagatgctcgcatcccaactaataacacagggagtttcgcttctttaatccgttgggctagtaaggttgtttcaaccggactagcagggcctaatttaggtgcgattaggggtttaattaccttagattggaccttggcgtccgtcacatcttgaggaacactgacaaaactggccccttgtttagctgattcagcttcttgataagcattggcaatcacttctgataaattttcaggttcttgcacttctgcactgaacttagtaattggtgcaaagagcgctgcattacgcatactttgatgggttaaacggagcaaatcagcccgtttcacttgcccggcaattgctaagacaggatcaccttcagcagtggcagtcacaacacctgtcgctaggttactagcaccaggcccagatgtcgccattacaacgcctggcttaccggtaattcggccgataccagctgccataaacgccgcattttgttcatgacgcgctaaaattaattgcggtgttttagggttaacgggatgttctagtcgttcaaacacccggtcaatcttggcaccaggaataccaaaaacgtattctacttcatgatttactaagctatcgataattgcatctgcaccgtagtactcttttttatcagtcatctatttaactgtaatttcatagctcgcattaaattcttcattaggtgctaattgattgacaccaaatttttctgaaagttcaccagaagcatcgacatcatcagcaattccccaccaaggttcaaggcaaaccaattcgccttccgttggataaggtgaccaaacaccgataaatggggcccctgagactttcaagctgatcgcatggtccgttttttcagaacgaatactaaatttattttcttgaccctttaattcgtaaattaaagcatcttctttaaaaagtgggtgattgatatcagttgccacatccgttggtgccaatgtgcgttcattcaaattgatgaatgcgccttgcaatggaatcttaacccgtgatttttgtggtcggtagtctaagaaatagtcttcaaattgggtatcgtccgttaatggcactttaaaaccgggatgccccccaacagagaagtacattgggccagattgcgctgtatttttaacatcatagcccacttttaggtgtgtgtcgtttacttggtaagaaacgcgtagttcaaattcaaatggataaatttttaaactttcttcatctgatttcaataagaatgtcacagccgtatcagtttggctttctacttcaaattgacggtcacgggcaaagccgtgttggcccattgggtaagttttaccttgatacgtatattgatcattcttagaacgcccaacaaacgggaataaaacgggtgcgtgacgaccccaaactttgggatccgcttgccagaggtattctaaccctgaaacggcccctttaacgctctgtaattccgcaccttgtggactaagtgttactgttaaaaattcatttgcaatttggatcatttatagaataaagcgggttaaatctttatcggctacaatcttaccaattttatcattaacatattgttcagtgatggtgatatcacccatctgcatatctggtccttcaaagagaatgtcttccaacaatttctccaagatggttgccaagcgccgcgcaccaatgttttcagtatcgtggttcacttggaaggcaatcgcagcaattctgccaatggcttccatcgtaaaggtgacgtgaacgccatctgccccgattaaagccatatattgcttaacaagcgcattattcggttccgttaagatccggacaaagtcggcttcagttaagtcttctaattcaactcgaattgggaaacggccttgtaattccgcaatcaaatcacttggtttagattccgcaaaggcaccagaaccgatgaagaggatatggtccgtcttaagcatcccgtatttcgtattaacttgtgagccttcaacgattggtaaaatatcgcgttgaaccccttcacgtgagacttcaccagattgttttttgccaccagcagcaatcttatcaatttcatcgataaagataatcccggtattttcagctctttgaagggcatcatgataaatatcggcatggttaactaacttatcagattcttcttgaatgaagatttcacgtgcttccttaacggtaacggttctgaccatcttctttttaggcatgatcgatcctaatgtatcgttcaagtcaattcccatttggcccatcatatcattcattggtgcggcctttttgggttcgtcaacttgaatttcgatttcacgatcgtccaagagtcccttatcaagttgttccttaacagataggcgttgatcacgtacttcatcggttacttcttcagtttcagcttggtttaagccagctagtgtttcaccattttgaagagcagtgaacattgacattaagtcgttcatgctattgttattcttacgttgttccttcttgataccagggactaataattttactaagcgtttgtccgcttgacgggccgctttcccgcgcacattcttgaattgttctgattcttccatgtgaacagcaacatccgctaagtctctgaccattgattcaacgtcacgaccaacataaccaacttctgtaaatttagttgcttcaaccttgattaaaggggcatcaacgactttcgctaagcgacgtgcgatctctgtcttaccgaccccggttggtccgatcatcaataagtttttaggtgtaatttcttgttgcatcttagtgcttaattgcatccgacggtaacggttatataacgcaaccgctacggcctttttagctttatcttggccaattacaaacttgtctaattcagcgacaattgatttgggtgtcttattcatcaaatccatctaaaatgattccacaatcacgttgtggttcgtataaacatcgatgccaccagcgatattcacgccagtttcaacgatttgttctgctgttaattcgggcttaccttctaaaatcaaggctgttgcagctgcttgggcaaaattaccacctgaaccaaccgcaatcacttgatcacctgattcagcaagtgtatcaggggtaatgacttcaccgttacctgagatcaaaagaatatctgtttcgttaatggcaatcaacattgcttctaatttttgaagcgttggatctttacgccagtcctgtgccaaggcaacagcggcgtgttgtaaatcacctgagtatttttctaatttttgttcaaaccattcttgtaacgtaaacgcatctgcaacgccaccggcaaaaccaattgcgactttattgccgtaaatccggcgaatttttttcgctgaatcttttgtgacgaatttttcgcccattgttacttgtccgtcgccagcaattgctgtccgaccattatgttttactgcacaaattgttgtcatctagtttttagcccgtgggaagaactgcctgtaatccttttgtaaatgggccgtcgtcacgtgggtgtaaatctgggtcgtcgataaactactgtggcctaataactcctgaaccgttcgcaaatccgccccgtggtctaataagtgggtcgcaaaggtatgccgaatcatgtggggatgaatgccactggttaaactggtctttttaaccacttgatccaatgcgtattcaattccccgactggtaatcggatttcctaaatggttgacgaaaaccacatcatgttcttgctggcgtttggccatcaattgcacccgaccatcgtctaaataatcctgcaaagccttagtcgcgtgattgccaaaaggcacgtaacgatccttattccctttaccatgtaccaaaataacccgtaaaccaaaatcaatctggccaatcgtgagttgggcacactcgctaacccgcatccctgttgcatataataactcaagaatggcgcgattacgttgggttagcggttcttgccccacaatcgcggcaaataacgcatccatttctttttcatagaaaaaacggggtaacttatggcgttgtttcttgagttggaccgtttcaaacggatcagtctgtaaaaattcgttgcgtaccaagtagcgataaaacgaccgcaaacttgaaatccggcgcgcaatcgtttcgccactatattttttttgatccatttcattcaaataagtttgtacttcaagggtgccgacctgtttaaaggaggtcaggcccccattagcggccaaaaaatcgacaaacgctttaatatcggcttgataggccttttgcgtttctggtgaatagtgtcgatcaacaattaagtattgtaaaaacaaattaatccaatcttgttcaagcgccaactagagtgtttctttaaatgtgtcaatacttgctaacgcacggtctgcaagtgcttgattccgttcttttttatcgcgaattcgttgttttaaaggttcgaaaattccgaagttcgcattcattggttggaaatgtttggcactggtatgcgtaatgtaatgtgccattgaacccattgccgttgttgctgggaaagtaactggttctgtgtctaatgctaaacgagcagcattaatcccagccactaagccagaagcagcactttcaacatacccttcgacacctgtcatttgaccggcgaagaataaatcagaacgttgttttgattggtaagttggtaatagcacgtctggtgatttcatgaaggtattacgatgcataacaccgtaacgaacaaattcagcattttctaaacctggaatcatccggaaaacgcgtttttgttcgccccacttcaaatgagtttggaacccaacaatgttataaagacttgcagcggcattatcctgacgtaattgaacaacagcataaggttgttcaccggtcttgggattttcaagcccaactggttttaaaggtccgaataacattgttttgataccgcgttttgccatgacttcaattggcatacaaccgtcgaagaatttttcatcttcaaagtcgtgcatttcagcaacttctgctgaaatcaaggccttataaaaggcttcgaattccgcttcagtcattgggcaattcaagtaagctgcttcacccttgtcataccgtgacttaaggtaaactttatcaaaatcgatactgtttttatccaggattggtgcagcggcgtcgtagaaatacaaaccttcactaccgtttaacgcactgatttcttctgctagaccaggtgacgttaatggaccagtagcaactactgtagggccttctgggaaagcggtcaattcttcgtgatgtacggttacccgttcatgattagcgagtttgtcggtgaccgtttgtgaaaatggtgtccgatcaacagctaacgcaccaccagcgggaacggcattttcgtccgctgcagcgataataattgaatctaaacggcgcatctcttctttaatcaaaccagccgcattcgtgacttgatttgcccgtagtgaattggtacaaactaattccgcaaattgttccgtgtgatgagcgggcgtcattttaaccggccgcatttcgtataaatgaacatcaacaccgcgtttggcgatttgccaagccgcttcggaaccagctaagccggcaccaatcacatttacaaaaggttttgtcgtcatttatttttgaacggcttcttcataatcaccattaggacagatgacttgtttgccgcctttaattttcttttcaactaagtaatgttcacacttaggacagtttctgccgactggtttatcccatgtgacaaaatcacagtctggataacgatcacagccgtagaataaccggtttttcttagatttacgttcaataacttgccccttgccacacttaggacatgtcacaccgatttctttgacgattgccttggtattgcgacaatctgggaagcgactgcaggcgaagaatttaccataacggcccattttgaccaccattggcgccccacaaatatcacaatcgaacccagccggttcatctttaatctgaattttttcgatttgaacgctagctttttcaacttctttttcaaaaggttggtagaaattatcaataatcttgatccaattttcttggcccgtttcaacttcatccaaacgatgttcaagatcggcagtaaagtcgatactgacaatatctgggaagaattcgacgattaaattattgacgatttcacctaattccgttggttcaaatcgtttagcattcaacttcacgtaatagcgtcgttgaatcgtttcaatcgttggtgaataggttgagggacgaccaacgccgttttcttcgagcgctttaaccaagttggcttcagaataacgtgccggtggttgcgtgaaatgttgcgctggatcggttttagctaatttcacttcatcgccaaccgctaattcaggtaataagttatctttcgctgaatcttcggtatcgcgggatgaaacgtatagcttagtaaaacctgggaagcgcatttgtgagccattagccttaaataagacgttgttttggttaatcttaaccgccactgtatcaaagacagcgggtgtcatttgactggcaacaaatcgtgaccaaatcaagttgtaaatcttatattgatcgtttgttaaaacatcttttaagctcttaggtgtccgcatcacagaagttggacggattgcttcatgggcatcttgtgcgccttctggatttttcgtcttatgggctttaacagcggcgtattcttcaccatagttatcgtgaatgaattgtgacgcttcgtgtttggcacccgttgaaatccgggttgaatcggtacgcatatacgtaatcaacccaaccgtgccttctttacccccgagattaatcccttcatataactgttgggcttgcatcatcgttttacgggttctaaagtttaacttccggttagcttcttgttgcagtgaactagtggtaaaaggtgccgccgcaaaacgcttgcgttcacgctttttgacatcttcaattgtaaaaggttgcgtcttatcaatttgctttaagacatcttgtactgcatcgttattgcctaaagctgttttcttaccgtttaaaccgtagaaactagctttaaatttactgcgacccttcttgaattcggcatctaatgaccaatattcttcaggtttgaaagctttgatttcttgttcgcgatcaatcacgagttttaacgcaactgattgcacccgaccggcactcaagccttttttaactttttgccagaggagtggactaattgaataacccacgattcggtctaatacccgtcgtgcttgttgggcatcgactaatttcatatcgatactacgtggatttttgaaggcactcttaacagtgtctttggtaatttcattgaagaccacccggtttttatcggttggatctaattttaaaatatgcgaaacatgccatgcaattgcttccccttcacgatcgggatcggctgctagatagatatgatccgcttttttagcgtgtttctttaattctttaattgtttcgcctttaccgcgaattgaaatatatttaggttcataattattttcgaaatccacacccatttgactcttgggtaaatcgcggatatgacccttacttgcaacgactttatagttgcgtccaagatatttctcaattgttttggcctttgcaggtgattctacaatgactaaatttttgcctgccatttaagcgttgacttgcgcactattagctaagatatctgcaataatgccggccaacttaatttgcgccatctgatcttcagccgctttttgaacctgatcataagcgtcattcaatgccgattgaatattagcacccaccaaacactgcggattggtcttttcatcgatgtgcaacaattgctgatcagtatcaagcgcctgatagacatctaaaacactaatctgctctgctggccgtgctaatttaggcgcaatcgtccctggacgactctccaataagtcagctttcaccaaaagggacatcaaccgacgcactaagctcgcgttggattcgatactgccagcaattgactggctcgataagtccccatcttgataaatttcgacataagctaagatatggatggcatcacttagtttgtgggaatatttcatctactttgattctgctggtaacaattcttgaagggctgcggttaatgatggcaatggtcgacctaagacatctggtaaatcacttgaaacttcatctaattcaccatcacgaattaagctttgaatcattgtaacaacaccaacgacttcagcaggtaaaccacttgcttcaagccctttttgatactcagcaatacttaatgatgataccgcaaattcttgattagtcaattgtgcaacactttcggctaaatcagcataagttgcgggtgcaccagcgaattcataaatgtcttttgcatcagtcatggctaataccttagcagctgcttcagcataaagacgttcaagtgtccaaccaacatgactgtcaccagcgccataaacaaatgattgaccagtgatagcacctttaattgtatcgagttcgttttcaaggtaccaattattacgtaagaaagaatgcgcaataccagattcgataatggccgcttctgttttacggtgatcttcagctaaaccggaagttgtttggtcagcgtgtggaaaacttgtataaccaatccagttaaccccggcttttttagcagcccggacaacggccatatgttgttgatcgcgtgggacttctgcgcctggttgcgatgagatgaatagtaggcgatcaacaccttgtaatgagtctgctaatgttgcttcttgtgtataatccccagggcgaacggtaacgcctgctggcaccatcttttgggctttttcaacgttccgtgccaaaccaataatatctgaagcaggtactaattttgctaattcgtgaacggctacttggccaaaacgtcctgttacagctgtaattgcatatttcatttaatcaaaataacgtagttcttctattaatatgtttttatctaacaatggtgtcgcacccgcggcgattaattggttgcacccctgtgacagtgattgatcaatgcgccccggaattgcataaacattgcgattagcttgaagggccaagttagcggtaatcaagctaccactcttgtgccgggcctccgtcacaattaagctatgacataaccccgcaatgattttattccgggctggaaattgataacgccgggctggtgtaccgagagcgtattcagatagtaacaagcctttttcagcaactacctgttgtaaatgctcattttgtggtggataactgcaattaatgcccgtgccaatcaccccaattggggccaaaccacgctgcaaggcaacttcgtgggccatcgcatccgccccttgtgctaacccactaataatcgtagtggcagttagtccttgtaataactgttctagtgattgcttagaataatgagtcgcttgacgcgccccgactaccgcgagacatggctgttttaacaatcttaaatcaccacgataaaataacaaaacaggtggcaaataggtttccaataagcgttgagggtagtctttatctaaaatcgttaaataagtcgttcgaacttcatggtcgatgcattggcgttgtaggtccgtactttgaaaactcgcttgaaaagtcggccaataacgttccggcaagcgcgcaatttgtgcaatttctaacgccgataacgtccaattatgactggttgctagccacgccgccaagcgtaattcactaataggcccaaaacccgccgctaaatgtacttttaagagtaattgatttttagttaacacctataaagcgttttgaactggggaaaaactacggcgatgaattggtgtaaccccgagttcagcaagtcccgctaaatgcttagctgtcccgtaacccatattgttggctaaatcataacccggatattgttgatcataattaatcatcaattgatcccgaatgacttttgcgacaatgctggctgaggcaatactaatactgcgggcatcgcctttgattaatttttcttggggaatatcagtcggtacggtcattgcatccactaataagtagtccggttgtttatccagaccagcaaccgcttcacccattgctaattctgttgcatggtagatgttttcggtatcgatccgttcaggtgacgcaattccgatactaacactgactgcctgggccataatctctcgatacaactcttgtttgagcttaaatgacagttgtttggaatcattgacctgccaaagatcaaaatcatggggcaaaatcacagcggccgtcacaacgggcccggctagtggtccacgacccacctcatcaattccggcgaccaatggataatcaggccagagcgctttttccatttgacgccgttcttcaaaagccgctttttgagccgctaattttgccgctcgcttatgatattgaactactaatttctgaacaccggcccgcgaatcagccgcaaaagtggccaactgttcttcggtcactggtgcttgtaataattgcttaatttcagcaatcgattgtgctttggtcatttatgacgcctccactggtacaacgtctaaagtgaagcgtcctaatttaccttggcgcgcatcattaatgaacttcacgcagaaacggtcataatcttctttgaagcctaaccgtttggttaaaatcatgattaattctgcagctggttcttcaagctcggcatctgtcactttataaactttttgaagttgacttggatagtattctttgaagtgttctaaggcaaaaataacgacatcgtctggatgatagatggcatctgaaatcgcaccggtaagggctaatttactgccgattgttgggtcttcaaatttgggccataaaacccctggtgtatcgagcaattcaagtgtttgtccggctttcaaccattgttggttcttcgtcacacctgggcgattacccgttacagcgatgttcttttgaactaaacgatttaaaatcgttgatttcccaacgttaggcacgccgacacacatcgcccggatgaccgggttgcgaatccctttaccacgttttttagccaatttttcagctaaaatttcttgtgctactttttcaatcatgggtaacttagccttatgctgtgcatcaagggcaattgcggtaatgccgcgtttcttgaacgtttcaatccattgttgtgtccgtcgtggatcagccatatcggccttattcataattaatagaatgggtttgttttgacctaattcttgaatcattggattaattgaagattccggtacacgggcgtccacaatttctaaaattaaatcaaccgccttgagccgttctttaatttgtttttgtgctttggccatgtgacctgggtaccattgtattgtcatttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacaacgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaattaatcgacagtagaagttttaacttgatttaacttaatcaaatcatttaattcgcttttatctttaacatcaattaaacaattgcgattttgtccaagataatctacccatgttaattgatacagaaatgttattttctttcccatcgaacctccaattattgcaccagttgttccgcctagtaagccacctgttaatgcctttccactactaaatacaccactacttgagtttaaaacctgacctgaaattggaccacatggaaaagccattgagtctattgactcgacaacccccgctggagttgcatagaacacgtgccgttcttgagattcatctgtgaatatgcaaggattagtagtatacatgtttataaaatcatataccatatgcgtactattaaactcactatctgtaaaggttctatcacataattcgttaaaaaaatattctgtagcagatccttcttttgttatgaactcctcattaccaagtattgatttaatccaaatattatttataagtgataatccattcttttctgatttcatatcaatagattgtccatcaaaagcaattgtatattcagtattaatttttaaatccattccagtatcatgtgcatatgtcatcaccatctcattcggtgttgctacaaggacaactttttctttctcacgagtataaccaaatgtcattgcataaaccgaactagggtcaagaagaggattttcactaaaaaaatctgccatactatttgtaatttctcgccaatctcctttaagatactcgtcagacttaaatgtaaacccatcttcttcattccatattttttcattaaacgtattatttttatttccatatttttcagggaataaaaacttatctaaaaagctcatctaaaagtttaaatacttagtaatatttttatttaccatttctgcaatattattcgtaattaatatctgttctgcccatttgtcatagagaagatcaccactctcttttgattttagctctctagacgctgactctatttctatttcattaggtgttaataaatccattgaagcctccactacacgattcaaattattctctaatcgatgcaatacctcttcattttcgattacgataatattttgtaaaaatttatcatcagccattctagcttcactactatctaaacttttcaatttaaaaaaagtatacaagaaacctttaatactctgattgactaatacataatacttcactggatcagattgataattgttaataaactcaacaaatttaggttccggagcaattgtaaaataccgtcctccatccaaactaacgccttgaacatcaaaaatctttgtaccacttataactaaatcaataatataccaagttatacttatatctgtctgtaaaaaactaaatggcataattttacttctatcatctaaatcttgttttatccgtatttgataggttggatcatcttgataatagtaataatactcaatatttacttctgatgattcttgataaatccatttatttggattttttaaagaactaattaacttttgcccaggtgttaaatccaattgcaatctttttttccaaagggcttccatggaatttgaatttgttgattggtttttacttgtatttgtatcttcaatccgcgaataaattacgcccgctggtatcgttacttttccatctttatattggtctgttaaataaaatggaacttgatttgagtccgagatcgtaataacatctattggtttttgctcaattttaagagtagaaacgcgcacattaggaatacgtccaccttcaaattttatttttcttaatatatcaattatattctgggtattctttcgattatcatcatcctgagtaccaatcactttaaacgttgcatcttctacaccaataataatataacagtccaaatgatgttgtgtatttgcgaaatttaatatatcacctactaaatcagctttatttttataccaaaattctttaaaatcccaaaaatcaccttcccgatttgtttctaataattcttgtattcttttactatctatcgctctgctcaccaattatttaaaataagtgatatcttcaagtggccaataaacgcctactgcgcggccgataattgtttcacgttcgattgtgccaaacgtgcgactatccttgctaattcggcgattatccccgagaacaaagtattggttagccggaatccgatcgtgatccgttaatgtttttaaatcaaaatcggaggttaaaaccgtcttttgctgcgattgcttcaaaaaaggttccacgactggccggtcattaacgtataattggccctcttgataagcgatatgctcacccggtagaccaatcacgcgcttcacataagttgtcccattggctaagcgaaaaacaacgatttcaaagcgatggacctgcccaaactttttcaataagagttgatcacccgatttaagggttggttgcattgaattcccagcaaccgtcgccggcaccaaaaagaaggaccggatgacaaaagcaaccagtccggccacgagaattgctaaaaaccaattacctgcgattgctagtttccgtctcatctatgcctgttcgctttcttgatatagctgataggcctcgtcaaaaattagcatgctcggtaaatagctaccgtttaactccaaatattgggataacggttcatagtccccttcatgtttagggaatgattgatcgaagaaagcattgttggcaaattgcgcaactggttcgtagttattcggatcgcgttgtgtcatgagataccgatagaaactctgcttcatttatttcttattttttagtggcacgtatacggataaatcaatcttatcgttcttcaaatcaatatggcgggccttgacttgcatcccgttagctaacttaaattcattcaagcgcaaggtaatgcgactcttatgcgcatttaaaacaacccatttagggaatttatattgacgttggatgtaattaaaaacaaatgacatcggtactttcaattgaccgacagccaattgcttagcacgtagttgaatatccccgttttcaagcacatatggtttgaaaaagaggttgaattcgaccggaaaacctaaaaacttaaattgaccagaaagaattgcttgttgatctagggtaaagttgtacttcacctttgaattctcaaggtagttttcaagataataggctactacgctattaatttgcttcttgtgcatctgaatatcaaaggtactgtcagctttgatcattttttcagtctgaacttgcttagtttgcggtgcactaacgttataggcgataaaaccgagcgtaccaatcactaatgctagtaaaacaataaagctatatttccaataattaatcgttcgtttagggctaacttgttccttttttaaatcttgtctggtttgcatttacttggtccaatctttttggtgtgcattcatctgttgccaaaaagcgttggtgatgagttgataccctttttgattagggtggaaatgatcgtcgtcgctaatatagggattgagatgctcgttttctgcaagtgttttttgcagtttactactgtccattttagcaagcgattttgtttgtttcacataatggccgtcaccatgcgttaaaagacggtcgctattgatataataagccgactcaaagtcattagcaacttctttgactgtcttattccatgctgtcacggcctttgacatccccgtaatctctgggaagtaaacgtaaaatggattatagacccccatcacgaaaattggtgccgttggattttgttggcgaatttgtctaaacagcgtcatcaaatgcgtttgataggccttttgcccggctgtaatctgtttttgatctaaatccaaaaagttattttgtaagaccgccattaaatcattgccaccgacggtcagtgtaatgatgtccgccttttttaaattcgcttgtagcgttggttgcgtgcgcacccttttttcgatctgcacgctggtatcaccggtgacaccatagttttcggtcgcgacaggatggtccgtttcagttttaattttagcggcaatccgcgaaacataaccttctttattttgctcatcaccaaccccgtgggtcaatgaatcgccgactgctactaaatgcagtgtttttttgactttctttggttgaacgactttcgttttctgaacactttcttgatgactacgtactttcattggacgtggtgtcaataactgccaaacgataaagacgacgagtaataccccggcaaatatccctaggtcgatcaacaattgtcgtatttttttcatttagttttcagtataatacatcactgcaaaagcaccggcgcccgcatgggttgcaatgactggatcagtggttcgtactaaaatttcgattgctggaaaggctgcttgtaattgcgccttgatcttttcactgagttccaaaccatcggcgtgtgaaataccgattgctttaacattttttaactttctgagatcatcatccatttcatcaatgaacttcgtaatagtcttcataccgcgacccttacggagcaccttaagctcactatcagcaacttcaaggattactttgatgtttaataagcttgaaattacaccggctgcatggcttaaacggccacctttaacaaggttggttaagtctgtaacacccatgtatagtttcgtattgtcatgaactgcttgaatagctgctaaggcatcctctaatgagccgcctgcttcaatcacttccgctgcttttaaaacttggaaggccattgcacgatctgtaaaatcactatcaataacagtgacgtcagctttcgccatttcgccagcttgacgcgctgtatcaactgtcccactaatcgcacgtagcatatgaattgatagaatttgactaccgtcagctgctagttgttcgtatgtttcgataaaattaccaatggctggttgactcgtcttaggaagcgcactagcactagccatttcagtcataaattgatcacgtgtgattgtttcaccatcaatatagacggtattgtcaatcatgatggtcaacggaatcaccgtaatatgatgttgtttaatttcttctggtgttaattgaattgatgaatccgttacgattttaatattagccactactacttcagccactcaacagacactaatctttgcgtcaactgcaagcacaaacagactagctgccaataaatctgcactaccacctggcgaaatatggtgttcttggcagtattggatcagcgccgtaaaactatcattggggagtgcgttttgaccagcctgaatggctaattgttgcatcttaataagtgtttgttgatcactacggtgtagcacgcaagtatccgcgactgatcccattaacgtcaatagcatctgaagttgagcttgttttggcgtatttgtttgccacttttgataagtctgaacggctaacaagatatgtggataccctaagacggcttcttcataagcgccatttacacgataccgtttttttacaacggcgccgtgtgtaacattttgagatgtatactgttcatccaggaattgggctaactgactcactttttttaaaacagtctcaatttgcgtagactgacgcatactaatttggtgcgcataaacgctcaccaagagacccatcacccaaatagcacccttatgtgtattaaccccaccagttgcttcaaacatagcttgttcagcggatcgaccaatctgtgcgattgtctctcgcaatgtctgatcgacaggatgacaccaagcagcttgtgccatttgttcaaaaaaaggcgtcaaagcccgtgccgacttgataaataaagacgcgtccatatccgtatgtgcaccattatcgcgcgcatcaactaaaccaggtttggggctcaactgaacctcgtcgactaaagcttgctcaactaaacaagccaattgtttagtcatcatttgttgtgccttattatttatcaattaactaaattgctttttaatccctgaccatcctaaatgaaggagccagctgagcataaacgcgccggttgccgtactcaagtatgcgaccacaatcatcgtccccattggtaatcgtaaccaagttgacttaaagactagtaataaggcttggaaaacaaaaacattggctaaatacgtccgataagcataaaccgctagccatttgaacaagggtaacttaggtgattgattaacaatcattcttgaggcaaacgtaaagacggtcagaataataatcaaactgtataagctttgcaaggtattcaaataaggcgcgtggccaaagttaacatcgccaggataagctaataaggcgtgtactgataatccacccattactaagccaacgggtagtaatgcaaaacgaatccgatttaactgcttaaaaattgcttcatgatagataaaaccggcaacgccataaatcccataaattaggaaactaacgacaaatcggtctaataaataccagctttcagctaatgggccgtttaaaacctgcatactataaaagagataccatccgatataaagaacagtggcacctatgagtaccggccaaacgagtttacgattggcaaaaacacgatagcccaaccaaataaagaacggcatcaataattgaatctgtaacatcatgaccgtataccatagatgcggtgcaccatcacctgtgataactttcaataaaaaggttcccacattagtgtatggtgttttttgttgcacacctgggaataccaataaataagcgattgtccatagtaagtatggtacaacgagttcaaaaaatttatcctttaaaaattcaaaataagatgttttctcactggttttaaccatattgtagacaatggcaaaaataaacatcggtgctgtgtatttagcaaatacataaagcgttccaacaaaagccgccgtcgtctgattgtgacaattagccaatgcaaaactcaatatggtttgtaacatgaccgccgtcacggctgatactttttgaaaatcactaacgtttattttagtcttctgatcttcgaacatttatgaccaaagttctttggttaatagcgggcctgcatcggtttttaataaaatctttttagccggtgttcgcaaatattcctttaatgcaaaaccacccttggcggttatcacttgcgtatcaaactgttcgaaaaaagaatgattggcagcaattaccgtaagcggtaattctgccggcgcgttagcatatagcaataaatcaaaatcactcgtcggcttaatagcgctaatgccagatgataattcaaaccctaagctgccaccaacaccccatttgaatcctgataatatttttctagcagcatgatattgcgcataaaccggaaattgtgcgacttcagtgactctgaaagattcacgcgtcgtaatttcccagggatgaataacagcttgaattgcactatcaggaatttcgagagcaaaccgctgattccgagctactccgcgaaggccgactggtaccaaatctaactgactagcaattccccgacgaataacgccgaaaacctgtttagtgagcgctaattgggccactaaagctggttgttgaataatttcacgatcaaagcgaacaatatcatgtgcagatttcatttaagcatcccattcttcatccatttttgcttggaccttattagtttcaacacggcccattttgacagcaatgtcatttgtgtaacggttcgtcaacatcgtatcgctcgtgtgacgaacgtcttcaatggcatcattaacgtcttcaatcacagttgcaacgttatcagtcgtcgttgtttgatctgtcacaccatctaagaaacgatacaaggcacctaatttattataattacggatatcgtaggcaattgaaggtactttttctgctgctgcttcaatttcagcaattgatcgtttagtaattcggctagcacttgctttagacatcgcttgaacagtaattgcatcgctgtttaaagcaattaaacggctagattgtaacccatgtgctaagaaagcacctgaaatagcattaccaacgaccaccccaattactgggtgccctgcttgccgtaatttggcataagccgctgcactattcgctagcgccacatgaatcccgattaattcttcgttataaccgtaagcttgactagggacatcaatgacgacaacgattggtcgtttaacggtcttattttgatcttcttcatagatgtgatttaagatttgtgccatccggaagccttctaccaagccaacttcgccatctcgtacacggtacattggatttttaccatccggtacaattgtcgttacgacagcatcttcactaaaacgatctgaatcaccataataaacagtactaattgttgaacttggattctttaaaccagttagcgcttggaaccagtcgtacccaacactggctgttgccggtgttgcttgttcagtaatcacaggtagttcaactgcttgtgtttggtgtttggcaagtgcttgattatagtcttcaatggccattggttttgaaagatcaagttttgccaataatgacaagtaaaagtccgcattttcactacggtggctatctttatgttcaaccattgcagccacgattgcagccttaacattttcgacgctatcagtcaccaattcatcaataatttgagcttcaacacgttgacgggcaccaattgtattccaaattaaatctttgtcgcttgaatcaaactcacggacgccggcttcttgttcgattacttctgggccattcaagccaacccgcgcttttttagtcgtaattaaataactcattaaagctgaagtaatggacatcccaccaaatgaaccaactcgcccagggacaaccccaatgacagggacgtactttttaagtgccacgattaagttgccaatttcagaaattgaaagtagaccataattggcctcttgtagccgcacgccaccagtatctaacacgataattgggaaattttcattaccattttgattttcagtcaaggcatgtgttagtgcagcgataatctttgcacctgaaacttcgccaattccaccaccttggaaactgccttccattgcgattacgacaacttctttattaccaatcgtcccacgtgacacgataatgccatcatcactttctgggacaattccttgagcaatcaagttaggagctgtcatttggtcaaaaggaccaactaattcgcgtccagtaggtgtgtccaataaagcattaacccgttcgcgggcttttaattctacaaaactatttctcatctatttctcatcagctagttcctccattgcttgtgttaatcgaagataaacgacaccgggtgttgcaccgaagtcattaatcacaatgtcggctgaaattggataacgatcaaagaaacgtgttaaaacatttccccatacctcatcaaaaccgtcactaccggtacagactttaactgttgattcagctttattggttggaaacattaaaatttctaaatcccctgatccaacgaccccgacgtgcactcgtttattaatgggttggcttgtttgatattgataagctaattgttccatttaacgctgttctttgctagttgccttgtaaagataggcaatcccttcttcagtcacaatatgcgttgtatcttcgctataaatcataacgggggcgtttgctagactcgcttgttcttgaacagcaagtgcatctaaggtttcaacaaaaactggtttcttattagaaccatatgtttcaaccatttggacgactaatttttggcctttgcctaaaggtttttcttcatcgcgtaatgattgccatgccggtgttgaatgacgacgtccaccaggattatgccccatgttaggtgcgccaccaaaactatggatactttcaacccaaccagattcaatcgctggaataattgttggatgtggatttaaagcccaatttttagcaattttacccttaaggcctagtgattcaccgtaggttggtaagagaagttcaatggcagctgtgttaaaaccaatcccatgattaagtgattggacaccatgttctgcataaatccctttaatcgccatcattgccattagaatctgaagttccgtaatattttgtggatcacgggtaaagagcgcttctaattcataaggtttgtccgctggaacaacaacatccacccagccagcaggaatatcaatccgtggtaattcatcaacgacttcattgacttgaacgatcacaatcccatctttaaatgcggctgcttcgacaatcgttggtgtttcttcggtattaaagccggtatataaattaccagctttatcagccttatctgcagcaaccaatacgacattaggaattaaatcaatgaataagcgaccatatagttctagataagtatgaatatcgcctaacttcattttgccgtcttcaatcatttgagcaacacgaacactttgtgcacctgcatatgaaaaatcaatttttgaagcaatttggcgttcaaagatattcaaatgttcgggacgtgaaatactcgacataatcatgtgtaaattatttactttttcagggttaacttgctctaagctttgtgacaagaaactggcttgcttttgattatccccttctaaaacgaccttatcaccaggggcaattaaggcctctagaactgtgataatttggtctgtttcaacatatttaccagtcattaactgactgattttggctaatcgttgtgctttttgaactcgtttcgtgtcccaattgcgttgtggtttttccattcatctccattttcgatatagaaacgttgtatcatcaatgccatgttggctaatattaatcgtcctgattaactgctctccaaaattagcatgaatcaactttgttaacgtattgcctggcggaaattcaatcgtcagatccattcccatttccttagcaacggccatcatttgtcgccattgtactggttgttcaatattggccaacaaatcctgacgaatggcttctgcatcctgtgtgagccgaccatccgtattctttaagtacggacaagtcgccggttgcaaagtcaattggttaatgtaaggcgttaatttttcaacggttgcttgcatcaacttacaatgtgatggcaccggaacctttaataatttagcggttcgtgcttgtttctgcttagctaccaccaaagtcttctcaaggccaattacggcacccgagattgtatgctgcattgggcagttctcatttgaaagatagaccggataatcgggatcaaatgtttcttgaactacttgagccgcctcatcccgggtcaatccaacaataacgcccatcgcataaccgcttggataagcagccttcattaatactgctcgttgataaaccaaccacacagcatcatcaaacgataacgtttgacaagcgacagcggcggcaaaagcccccaacgaatgtccagcaaccaagtcaggcacgatatcattcttttggatttcgtctaaagcaaataatgccttcactaacaacgccaattgaataaagacggtatcctcataattctgagggtcatcaattaattgatagcctgtcactttagcgacccgctcaaggtattcaacgggaatatcttgtaacatcccgacttgttgactgccttgccctggaaataaaaatgctgtactcatatgaaattaattcatttacaatactttaaaaaagtctttgaaactcaaaatattacacaggcagccggggtaacactgttttatcacaccggtcgtaatattgaagcaacaccatatgcccataccttctacccctacgttaccaagacactagccatacttgatgacggatttcgcgcagttactgccttaaataaggagattatcacctcagtgacgctttgtttagaagttgcctctgtgtcggtgccaaacctaattcgaattttttcagaaaaacatcctgatattaaattaacaattatccaacatcatctcccagaaaatattaatgaatcggttttatttattacatcggattcaaagccggatttaaataatgtcccgattataaaagagcccgtcttagtcgctatcccgaaatcacatccattagctcacaaagcaattttgcaaacaagtgatattgaacaaacacccattattatgttgagtcccagcaacgcttttcgtaatacgattgatatggcgcttgaagctaatcatattcaccctaaaattagttcaacaacggatgatcctggcacattgcgctccatcattaatcaggggttaggaatcaccttcttcccgcaaatttcttggtcatatcgagctaacgatcacttcgtcctcaaagaaattgcggacatctcaattgaacgaactatctatctttcttcaacactgcgaaaagatcacccgcttgttgaaacaattgtgacgacactccgagaatggttcatctgccacaattaattattcagttattctttgataaatctcaaatgtatgcgggtattgattacgttcatcaaccgtccctgcttgttgcgaaattaatttaaattgcgtgtagtcaattgttggcatataaacatcaccttggaacttgtcggcaatcttcgtaacgtataaatagtcgacatcagccgcaaaaagtttaaagatatcagcaccgccgataatgaataatttttgcgtgggatgctctttttgataatcaagcagttgtgtacgctcattaaaaactaaaacgtctttagcaactgtcaaaccgctttggcgtgtaatcacaatgttttgacggccgggtaacggctttttaggcaagctgtcatacgttttgcgccccataatgactgcttcgttaatcgtttcgcgtttaaaattggctagatcattgggtaagcgccaaggtaaatgcccatcttgaccgattaagccgttttgatcttcggcccataaaaatgctatcatctataccgcaacaggtgctttaattgcgggttctgattcataattttccactttaatatcagcaacatcaaaatcaaaaatgctcttcttatctgggtttaaccataatttgggtgcagcatgcattgatcgtgccaattgagtcttcacttgggtcacgtggttactataaatatgtgcatcccccagagtatggatgaattcaccgacctcaagcccagtttcatgagcaatcaaatgcgttaataacgcatagctagcgatgttaaacggtacacctaggaagacgtccccacttcgttgatagagttgacatgaaagcttaccatcattgacgtaaaattggaacatggtgtgacaaggcggtaaagccatactaggcacatcttctggattccaagcagacacaatcaaccgtcgtgaatcaggattcgttttaatcatttcgataacgtttttaatctgatcaatggcttcaccggaacgtgtttgccaagcgcgccattgcttaccgtaaatatcacctaattcgccgtattgttttgcaaatccctcgtcggctaagatccggtcgttaaataggcgcatttgttcttgataaacagctttgaaatcagcatcgtcttgagcccggtgactgaaatcggtcatgtcaggaccggtgtaatcagtacttttaacgaagcgttcaaatgcccattcatcccaaatatggttattatgttgtaataaataacgaatgttcgaatccccttttaaaaaccacaagagttcactcttgattaaaccaaaaggcaccttcttcgtcgtcaataaagggaaaccctcttgtaaattgaaccgcatttgatagccaaagaggctataggtaccggtattagtccgatcttccttgtagtgaccctcttctaagattgtccgtgctaaatcgaggtatacttgttctgacatttagtctgcgtattcgcttaggtagtcccagcgcgccattttttcatctaattcttggtttaaacggtctaactcagcttgccattcggctaatttaccgtaatcagcaccattttgattcatctcagtcttgattgtttcgatttgttcatctagcttttcaagatccgtttcaatatgggcgtattccttttgttcgttatacgttaacttatgtttagcggctggttccttaaccgtttcgacagtgacttcaggtgtgggcttaggtgccgttgccttggttgttgctgttttttgtttagccaagtagtcactaaacaagccgacttctgtcgtaatattgccgtgaccatcgagtactaataatttatcggcaacttgatctaggaaataacggtcatgggaaacggtaatgacggtcccgttaaagttttcaagatagttttcaagaatcgttaatgtcccgatatcaagatcattagttggttcgtccaataataaaacgtttggttgttgcatcaataattttaagagatataaccggcgtttttcgccaccagataatttcttaattaacgtcccatgtgttgaccggtcaaagaggaactgctccaataattgcgtgacactaatccggtccccatttttgccgacaacttcttcaccggcttcttggaggtaagcaatcacccgtttatcaagatctaaatcttcattttgttgcgtgtaataacccaagttaaccgtctcgccgacgaccaattcaccactatctagcggaatccgttcggctaaaacatttagtagtgaagacttaccagcaccgttcaccccagtaatcccaattcgatcattggcttgcactaacaagctgaaatctttcaagataggatgggcatcaagcgtcaagttagcgttttttagttccaagactttcttacccaaacgtgattgccccatttgaatatcaacttcggcagtatccggcccagttgtcagattgcccttcaaatcgttaaaccgattgattcgcgcttgttgttttgtcgtccgggctttagccccggcgcgcatccacgtcaattcttgcttatagagttgttgttgtttatgggcggcttgttgttcgcgttcaatccgatccgctttttgtgttaagaattgttcgtagttcccggtatacgtatagagttgaccggcgtccaattcaaaaatttgattcgcaacccgatccaagaagtagcgatcatgcgtcacgattaaaagtgcgcccttgtattgtgctaagcgtttttctaaccattcgatagaatcaaaatcaaggtggttagtcggttcgtctaagattaataaatctgggctttcaatcaaggcttgtgccaaaccaacccgtttttgttggccccctgagagcgtattaatcggttgatctaagtcagttaaatgcaattgcgtcaagattgttttgatatcggtatccacagtccaagcatcttgttgcgtcatctgcgcatcagcttgttcatattgcgtttgcaacttaggattcgttggatcagccgtataagctgccaggacacgttcatagttctgaatcgtcttaaacactggattttggccggcaaaaatagcggccatgatactcaaattagtatcaaagaccggtttttgcgctaaataactcatcgcgtattgattaggggtttcaatctggccactatcataagagtcagtgcctgttaacgcgtttaataacgtcgtcttcccagtcccgttaatcccaacgaggccaatttgatcaccttcgcgaattaaaaatgagatatctttaaagagcgttttttcgccataagtcttcgttaagttcgtcgctgttaatgtttgcaattaaatttcaggatattcatcggcaattgagcttgtagcatcaatgacgatgtataaatgaccatttttttgtgagatttggctggtttgataaatgttatctaaaccgcttgtatccttattcttgaatgggaagtagatttgaagtggtttcttatcttgttcgtcttcaaagataaggtctaacttctcaatatcttgatacttcgttgcgcgaccaaacatccccatttcaagtgagccagtattaatgtcttcactcttaacatgatcagcttctggtaagatttcagctttaaaactcttacatggatgaatttcttgcattgggccaccgttaattcggccatagctggttgttacccggctaatccaaatatcgttcaattccttgtggttgattgtccatgcgtcaccatttctaaaatacaatttcaattctttaaaaacgtgttgtgccatttatttagcggcctttagtaacgcttccgtcgtatttggtaactcgtctaggaccactttccgttctaaaatagctagtgttttgcctaaaataggccctggttggaagccattttgcatcaatatttgaccattaatcgctaaatcggctttttgcttaatttgtaaccgatcatagcgttctaaccagtcagcagttggaattgtcgcagtcgtcaccaattgtgcgatttgcagactaatcactaacaccgattgaccagcttgataaaggtcccattggtcggcagttgccgtcaataatttagggagtaagaccaaaccggctttaaccgcatcaatcacatcattagcactcttccaatgcttcaaaaaacggccagcttgtgcgggtgtttgcccgagtaaataggtcaccactaaccaaaccgcactttcatcatgtaattgttccgttggtaaggccgtcaattgttccaaagccggtaattgatcagctaaatccgggcaatatcgatataagcccgtgtcaataaacgtccgtaacccattttgccgttcaatcccttgcatcaacttcataaattcaacgtgaatgcgttcaatcgcaattttttcaagcaaggcagcgtgcttttcaatagcggcttgcgtggtttcagtcactgaaaaaccgagttggctctcaaaccgaactgcccgcatcatccgtagtgcatcttcatggaaacgttcatcggcgacaccgaccgcacgaattttatgcgccttcaaatcagcaatgccgtcaaaaagatcgatgatttcaccatctgcgcgcatcgctaaggcgttaatggtaaagtcacgccgtttcaaatcctcttccaacgagcggacaaacgttactgaatcaggccgccggaaatcttgatacccggtttccgttctaaaagttgtcacttcgtagccattgccatggtctaaaatcatgaccgtgccatgttgaatcccagtatcgacagtccgtttaaaaatttgtttgatttcagctggataggcagatgtcgcaatatcaacatcatgaattggtaagcccaataaattatcacggacactccccccaacaaagtaagcctcaaaaccagctgcttcaatttgttctaggattggcagtgcttctgcaaattcgggcgcaaaagtcgttaatttcatatgacacaaaaaacaaatttgaccaccactcttcgtgatttaatcgcgattgccattggttgtgcgatttacgcctttggtttgattacgattaacattcaaaatcatttagctgaaggcggcttaaccgggattaccttaattgtgcgctattggcttcatattgatccagcctatacaactttaattttaaatatcccgttagtaattcttgggtacaaatttttaggtaaacgcgccttagcctatacaatttacggtaccgtcatgatgtccgtcttcttatggatttggcaacgagttcctgtcaccattaacttaaaccatgatatttttatcgccgcgctacttgctggtttgtgtggtggctttggtagtggtatcatctaccgctacggtggaacaaccggtggtagtgatgtgattgctaggattattgaaaaacggcgtggtgttcaaatgggacgctccctattaatttttgatatttttgttttaacagcttctctcagttacctcgatatcgaacacatgatgtataccctaatcgcatcgtacgttttctcccgcgtcgttaactttacactcgaagggacctatgcggccaaaggcttgttagtcgtcagtgatcactatcaaaagattgccgatcaaatcatgactcaaaccggtcggggcgtgactttcttacacgctgaaggtggttattcacaccaatcgcgtcaaatgatttattgtgtcgtcagtgctagcgaagtggcccacctcaaaagaattattgaacaccaagaccctacagccttcatttcaattattgacgtccatgaagcgctaggagaaggctttacgtatgagacaccaacgaaagattaattacttcgtaatatttaaatccaccgcttgatagaatgcgtttgctgtatccgaaatattccaaacacccagcagcacattatagccacttctgtcggttggaatattaatcgtctgtgcaacatctttggctggtaactttccttgatcatcaatcgaagtaatcttttcaaagtttaaaatacttagcggttgatttggattccaacctgggcgggttaagtagtaatcccacgtacttgttttatgttgtgccgttaagtgccacttaatcgttaatgcgcctgatttaacttgattttgatgccatctcgtactcgtttgttcatcaagattcgaaaatgaactgatattagcactcgctaattttccatcgataaatgtattcttaggggcttcaatactttgtggctcgtattgaacttgaccaacattggtgttcaatggtttttgaccggtatcatttgtgaacgcattactacctaaatacgctcgactacctggggatgtgatatacccgtgtgcgctaacttgtccggcacctaatgctgtcacacctaatactgaacaaaagccaacgatggtccatttcaataattgcttcttcatcatttatagtaattctttaccgtcgatcatttcgatttctttttcttcttcctccgccgttatgaaatactgttgattgcgaagaacgaataaaatccctattaatatcatcaagcctgcgaagtaaaatgtccagtgagctgaccatttttcagcaattttaccagcgacaaaaggcgcaatggccccaccggtaaaccgaatgaaactgtaggcagacgatgcgacactacgttcaatcgtcttattttccatcgcaaccgttgttaagagcgtattgactaagccttggaagaagccagcgatgatcacgccaaaggccactaggactggttgatcagcattaatcccaatcactactaagcaaacgaggaaaaagcccaacccaatcaacaatgtcattaacgtattcgttttttgttctaagcgaggtgccacaaaaacggacgcaatggcgagtaagattccccagccaaagaaaacaaacccgacttgcatttcagtgagcccaactaataaaaagggtgcgtacgctaaaattgtaaagaagccaaagttatacaacaatgcaataattccgattgagcggaggcgatgattttttaaggcaaccgcgccggcaaaaaagcgcgcttttttaactggtttggcaattggttctaataaaaagacaatcgtcatcgcagcgacaaacattaagattgctacgccataaaacggaaaacgccaagaaaaactccccagcgccccaccgactaacggaccaactgccattccgattcccattgaaccttcgtataacataatggcttgttccgttttttcaggcatcacactgacaattgccgttaacgccgtcgataagaacaatgcgtttccaaagccccaaccggcccgcaacgaaattaattgtgagattgtctgtgaacgacctgccaaagcggcaaataatacaataataattaaaccgatactaattgttcttttggcaccaattctagtcgaaataaaaccggtaaataacataataatccctgtcaccaacatataactcgtaaataatagcgttgtttgcgcaggtgtcgcgttcaatttaaccgcgatggtttttaaaatcggatcaactaagccaatccccataaaagcgaccatacacgtaaaagctaaggcatacgctgatcgcagccctttattttgattctccattaacatatgagtacactcagctatattttattatgtatgttagttcgtaaaccttgcagtggttatgagctaaagcagtatattaatttattttggaaagcacaccatagtcaaatttatacagctttgaataaacttcatgaacaaggctacgtatcagtcgaaaccgatgccattcacaagcaaaaaaaaatttatcacttaacacctgaagggcaactcgtagttgctgactggttccaagaagaaacaaacgtccctactcaacgtgacgaatttttagctaaagtgtatgtcattgctttattcaaccaagaacaggccacctctttacttcaagatcgccgtcaccattaccaaaaaacacaaaaacaataccaacataaaacgcaagaatacgacgccattacagattcaatcgaaaaacagaagaatttgggccgctacctcatcttgaaacgccgcttaatggtttgtgccaccgaattagaatggtgcgattgggcacaggatatccttactctcaatcaaaacaaataattattctttggttagccaattcccatgataaacgcggaatacgttcacaatcgttagtaaacaaaacatgctacttgccatcaagaacggtccagccagcaaagctgacattgaaatgggcgcttggtgcaaaatggttcgcccgacatgaatcgtcaagccccaaactaagccccctgcaagtaggctcgctacaagactaacccctactaagattacgacgttcaattgttgtgtcagcaataactgttgttgcgttaaaccaagcaactgtaattggcgcatctgttggtcattatcctcctttgcgactaacatcgtcgccaacacatttgctaaaacaatcaacaaaggggcgcctaaatataaaccgattgtcaaaatgaaattcactaatcgctcattgttggcacttgtggtatttgtataggctggtatattccacataattgccgacatccctgttattaaaaccgcaatgattgtcactggcgtatacaacggtaaatattttttaacagcatagtcaatatcgtgagctgccaagtttaaaaagagcgttctagcacctagccaatagagacctcggctagctagttttaatactgtttgcccggtaagcgtaattagaatcagtagtaagaacaacacaagattcagattaccaacagaattaccgagaccgacaatcactttttcagactgcccaacgtaggttaacgtcataatttgcatcgccagtttaatgattaatccaatgacgaccattaacaaaacaatcatcttaattctacaaacgatccgccgccggtgactgggatgcttatttccatcctttagttgatggcgtgcatgccaaaaaccaccactaccagcaattagactagccaggataaccgttaacaaaagtgccatgaacgaaaaatgaatcgacatattcggcaacattttgggcccaacaatctgctgcaaccaaacataacaaaaacgcgttagcggcaaagcaatgactccgccaagtagagcacttaccccactaacaattccgatttgaatccccaaaatagcggctaatgcattgaccgtcgcacctagaatcgcaagcattcggtagtccgctttaaactgatccaaaagctggttcacgattcctttaatcacgattaacattgtgatgccaccaaaaactatgggcatgataaaaatagggagcggtgtattctgaccgtatagatcaacttgctgcgactccgccacattcacaattcccgttaaacaaaaaccgaggattaaaccaaccgttacaaaaaccggtattgttgctagccattgacgccaggaatgctttaactgtaaccaactgatcgtccacatttacaccaccttatccaaggctgcatagattgcctcaagtgacggttcaggcacaatttgttgaacctgaccgtcttttaatacaatcgcacgatctgtctgactagccaactcaatatcgtgggtcaccataatcaccgttttacctttggcaaccatctctttgaaatatgtaaaaataatcgatttggataccgaatctagcgcacccgttggttcatcagcaaacagcacatcacaatcagttagaatcgtgcgggcaatcgcgactttttgttgctcaccacctgataaggtctcaactgcaccatcgatttgacctgcaaagttcaattttgtcagtaattgttcaatctcagaacgtttcggttgctgatgactcagtcgttgctgtataacgatattttcaaacacaggaagtgactgaattaaattatattgttgaaagatgaagccaattatctgtctacgaaaagccgctaattgattaggtttcaattgatacggattaacccctgcaattgtcacggtgccgcttgttggcctcgtaatcccagaaatactgtataatagcgtactcttaccggatccagagggtcccacaatgctcaccaattctcctttttggaccttaaacgaaatatttttcaatatggttgtcgtttggtcagactgcccaattggtaccacctgtgttaactgatcaactgaaagtactgtatttgtcatttattgcattgtttgataatcatcatagagggtctgcatatcaaggtcatttggcactaattgcaagtattgtttcaaagccgctagtaattctgggacttgcgccatttcttggaagaataggattaagtcgtgtaagaattctggattatcctttaattccggataagcgagcaaataattatcacgtgcatcgtcgaatgcttcaatcgcaaattgtgattgtgccaatgaccaataaagttcagccgttggtttatgattggcaattgcttcttgcacaaaggccacgttttctgcatgacgattttgccggcgataaacttgactcaaggcactgatttcacccatattatctggattaatttctaaagccttgtttaacatttgttccgcaacttggtcgtcacctaattggagggctaaatcgctccccttttgatagaggacctcactatacatatcgtagccaattccggtttgaacggtcgtgagcgcttcttgaagctcattttgagcctcttgggctgtcgctaggtaaacgtaaagcgatgtatattgcggatcagctaattgaagcttcgtgagaatttcaattgccttttgataatccttgatttgtaagtacaagaagcccatttggaactgatcgtcttccgttaagaattcgacggtcattgtttcgtagatttggagtgcttcttcaaaagcaccgctgctggcataacttgttgccaaacgtttttgaatattaacttgacccaattccatcacatcttggtcaattaaggcttcgtagtagttagccgccttaccgtattcccccatttcaaagtacaattcggcaagcgcaaactgcatcactggttcgtcgggataaaggcgcagcgccgtcaataacttctgttcactgacttctggcaagcccatcgtttggtacacgtcagctgccgttaacaggctttctgcgtatgcattagattccggcgtaatatccgtcagtaagttaagagcgtcgtcgtattggccattgctgaccgcaatatcggccaacgtcgtccgaatttgatcttcatctgggaattgcgctaataattgttgatagattgtcgatgcttgttccaagaaacccattgcgtagagttcttcggccaaactgtacaacgtttctggatcgtcttcttttaaagccttttggaaaagctcatcggcttgttttaaatcgttatcttctaatgctgatagcattttttctgaattcgtcatttatttaacagaatcctttaaagctttacctggcttgaatgcaggtactttgcttgcaggaatcttgatttctgcaccagtttgtgggttacggcccttacgagctgcacgttcacgtacttcgaatgtaccaaagccgattagttgaactttgtcaccttgtttcaaagtgtcttggattgaaccaaatactgcgtctactgcagcagttgcatctttcttagttaaaccagtctttgatgcaacgttttcgatcaattgtgctttgtttgccatttatttccgttgacgagggatcaaatgaattggtgtaccggtaaagtcaaacgttttgcgtagttgattcttcaagaaacgttggtatgagaaatgtaatagattaatgtcgttaacgaagacaacaaatgtcggtggttgaaccgccacttgtgtcatgtaataaattctcaaacgtttcccgttaatcgctggcgttggtgtgaccgttgtggcttccatcaagacgtcatttaataaggctgattgaattcgtctgttttggttttcactgactaattcgatcattgctggtaagttttgaagacgaacacccgtcttagctgaaacaaagatgattggtgcgtagtctaagtattggaattgattccgaatatggtcttcgaattccttcatcgtatggttatctttttcaagcgtatcccacttattaacgacgatgataatcccacgaccggcttcatgtgcgtagccagcaactttcttatcttgttcccgaataccttcttcagcattcaagacgactaatacgacgtctgaacggtcaatcgcacgtaaagcacgcataacagcgtacttttcagtattttcgtagaccttaccacgtttacgaatcccggcagtatcaatcattgtaaattcttgattattttccgccatgaacttcgtatcgatagcatcacgagttgtcccttcaatttgagaaacaatcacacgatcttcttttaacatcgcattcactaatgatgatttaccaacgttgggacgaccgattaaactaaatttaatactatcatcgtcttcttcttcaagatccgttggaaatttagcaacagccgcatctaataaatcaccgaccccttggccatgtgcaccagaaacgggaattggatcaccaaagcctaagctgtagaaatcaaagatatcttgacgttgttctggattatcggctttattaacccctaataggattggtttgtcagcgcgataaagaatttgtgcaacacgttcatcagcatctgtcacgccttctctggcactcactaagaagataatcacgtctgcttcatcaattgcgatttctgcttgttgtttaatttgttccataaatggtgcatcactaatttcaatcccaccggtatcgattagactgaattcatgacctaaccattcacttgctgtataaatccggtcacgtgtaacacctggcgtatcttcaacgattgagatccgttcgcccgcgatccggttaaaaattgttgatttaccgacgttaggacggccaacaattgcgataactggttttgacatctatttttcgtctaatgctttaccaagcatatcaccgatactaaagccagtttcttcttctggcatttcgtaatctgatggtgcaacgtcttcctgttcagaatccttagcacctgctggtttttcttgtaaagctttgattgataaacctaaacgttgttgttcaggatcaactgacaagactttcacttgaacagtttgtccttcttctaaaacatcgtttggtgttgcaatatgttgatgtgagatttgtgaaatgtgcacaagaccttcaacaccagggaagacttcaacaaacgcaccaaaagtagttaaacgtttaacagtcccttctaatgtgctgccgacaggtgctttttcagcgatgtcatcccaaggaccaggttgtgtatctttaattgataatgaaatccggcctttttcttggtctaagctaagaatcttaactttcacgttttgaccaacttctaatacatcagaaggttggttaatgtgatcgtatgagatttctgaaacgtgaactaaaccatcaacgccgcctaagtcaacaaaggcaccgaagttagttaaacgtgcaacttcgccttcaacaatatcaccaggcaatagtttttcaaaaacggctttaagttgtgcttgacgttcttgttctactaatgctttacgtgataagattaagcgattttcgcttggttcaatttcaatgatttgtaattctaattcttgacccttaaagctattaagatcacgaacgaaacgatctgaaagcatagaagcaggtacaaagccacgtacgccagcatcaacaactaagccgcctttgacaacgtttaaaactgttgctttaattgtttctttattttcaaatttttgttcgatttctgcccaaactttacgggcttctaaacggcgcttagataataagtagctaccattttccttgtcgttaccgattgtcgcaataacaactaaatcaaattgatcaccaactttgacagcgtccgttaatgtttcaattggttgacttgataattccttttgaggaacaacgccttcaacgccagttccttcaataccaacaatgacttgtcggtcttcaattactaaaacttcacccttaacaacgtccccaattttgacttcatggacactatctaaagcagctgccattgtttcactgctttgggtgtcattcaaattagcatcattcatttacatattttgtttcgcaatcgttaaaatttcagcaacaacgtcatcaattgagagctttgtcgtgtcaatttcgattgcatcgtcagcttttctaagcggtgaaactgcccgtgtactgtctttttgatcacgtaattcgatttctgcttgtaacgttgctaatggggtcataatccctttagccgtattttcagcataacgccgtttagcacgttctttcgcactagccaccatgaaaatcttaacttttgcatctggtaaaacagtcgtgccaatatcgcgaccatccatgacaacttgcccttgttcagcaatttggcgttgacgatcaaccatttctgttcgaactgctggtaatgctgaaacttgtgagacattattcgtaatttctggtgtccgaatcgctaaagtaatgtctaaaccatttaagaagactttttgaccagcttcatctggttggaactgaatatcagctttagttaattcagccatcaaaccggcttcatcaccataatcaaggcctagttgttgtgccaagacggttgctgagcgatacattgctcccgtatcaacataaacgaaccctaacttagtggcaacaatcttagccacggtactcttaccagacgatgctggtccatcaattgcaatttgcatttatttaaccttgagtgcggttcctggtgcaacacttgaattagctgttaatcctggattcaatgctaataattcactcaatgacatgccgttgttggcagcagcacggtaaaggccttcaccttgtttaagggtataagtaccacccgctgtttcagatgaagatgagctgcttgacgcttcagcttgactttgacttgaactagcagcagattctgaagcagcttgttgactagcactatcagcggcagcttgttgttgactagctgcttgttcactagctgcttgtgctttagcactttcgctagcagacttagcactagctgcctcactatcagccttcgccttactttcactggctgctttactttcagctgcttcttggctttcactggcttctttagcctttttagcagttgatttactcttactcttctcgctatcagcggttttgacgacaatcttagaatcttctaaaccggggcggttcgcacgactagaatgaacggtgtaagcgataattggaaatgcgatcattaaaactaataatacagctagaataatagcaaaatatgtatttcctttttccttactcttggcagcgacgcgggataaatttcctttgtcatcccgatcatcgtcgaactggctttcccagggtttttcttccgtcggattatcttgttttttcttatcatctttgagcatctaaaataattggtccaagattcccgtccaaccagtcagaacaacggtttcagcggttttataattaatagcctgttctaagtctaattgtgctaaaaagtcggtcgaatcctgttccccgcaacacgtttcgctgtgttcaatcgtctttggtgcctggtcaaaatagttcacaataaattgccgtcgacagcccttgagggtcaaataatccagcatcgtttgtagtgaaaactgcttttcggtttgacgattatccaataacttaatgacctcttcttcggtcatccccagttgctggtagcgacgtagtagttcaaattcattgccttgactttgtttaaataattgcggttcctgataatagcgccgaatgaggcctggttccggaattccaaatgaaacgagtgattgttgtaaatataaatcttgcggagttgttaggactaaagcataggctggttgcccatctcgacctgcccgtccgatttcttgcaagtaactttcgatgttttgtggcaggtgataatgaatcacatagcgaatatccgccttattaatccccatcccaaaagcattggttgtacaaatcaaatcaagttgtccttgcataaattgttgttgaatcaaataccgctcctgggttgataacgccgcgtggtaatacgcaatcttcagatcagtttcttgctgcaaaaaggccgcaatctccatcgtcttttgccgacttgaaaaataaataatcccgggaccttggcttttttgcactaagctggctaaaaattgattctttgcttgttcatcaggttgttggctcacgcccaaatagatattggggcgatcaacagaggtcatgatttgggccgcgttttttaacgccaacttattcaaaatatcttggcgtacacgatcattggcagttgccgtcaaagccaatgttgcggttggccgcaattgggccttgatggttgctaaaactaaatagtccggtctaaaatcaatcccccattgtgaaatacaatgggcctcatcaaccacaaataaatcaatttggcaacgttggagcgcttgaatcacttccggttgactgatagtctccggtgccataaaaataaagcggtagtccgctaaatgcgtcaacaactggtatttttgctgaggcactaaattagaattaatggcgacagctcgcttttccccttggtaattcaattgggcgacctgatcttgcattaatgcgattagtggcgagacaatcacagtcgtatgccccaagatataggccggtaattgataacacagcgacttcccagtcccagttggtaaaacggctaatgtctcctgcccagcaagtaccgactgaataaccgctaactggcccggtttaaaggttgaatagccaaagtgctgcgctaactggtcataaatgagttgttcagaagtcattcatgcagccaccaccttcgttttaatttgatataaccgataactgaaaaaatccagtgttggtaattgttcatgcgcagcattaaatgttaaatccggcatctcagtcatcaaagcagccaaagcggtctctaaatctggactaataaaccgctcaaacggaaactgcggctgcaagattgctgtttctaaaatgtgttccctaatcgtacctaacttaacccgccgtttttggctaatcgtttcaatggattgtccttgttgcaataacgtccacgtttgcgccgtacttaaactcaagatggcatccaatggtgacaataaacccgctaataacggatagtcggttgtatgctggctgaggatggcaaaaaaatgggcttgcgcatctaacaaccgaatggtcacgatcagtggtgcgatcgttaatttttgtgcgagttgctgttgactctgtccgattatttggtgaccaaccaagcgattcgccaataaatcagcctgaacaggtgttaactgcgttaagatctgttgtaattcttgtttaaactgagtgaccatctctgaatcttgtttatgctgtttaaaccaactgacaacttgcacacgatcacgcatgctagtttcaattggaaaataatgtgtgttatggtgactatattccgacataatttgaatcgccaaaaataagcggcattgaaactgctgtaaatggcccatttctgggccgtaataatgcgttggccactccaaagtcgtcattaatgtagccttttgatcggcaccagccggcgtcaaccaagcttgccgatcttcaaccattaaccaacctttttcttgtagttgtgttaattcagcttgaaattgggctaattctagattaggataaatctgaagccactttaataaaccatacgctaaaccagcgtacaagttggatgtggtgcgcttaccgaccaatgtataataaatggcttggtagcgacggggttccgtcgcaaataaacagagtaagtagtctgttaacatatgctctatagtaaagttatccctgagcggtgtattgcgtgcgggttatgccagttaaaagcacctgaactcttcgactatgatcacgaaggtgttgctttttttaaaccggacaataatgccggccaaacccccatcgaaaatccgcatgagctaatcgcttttaaagccgcttataccgcttgtccgacccgcgcaatcgtccgtcaggaggaaccattttcatcgtagctaaactgctgttttcatatgttgttttaaccatggcaaaattctaagatataagactgcaaagacgactgtgaccaacgcacccttaatcaaattaaagggcactagtccgataaagacgtatttagtcatcgacatccctaaattaaagttcaatagcttaatatacatcggtaagatgaataaccagttggctaagcacatcacgattgtcatgctgattgaactgactgttccggcaatcacttgcccccacagcacactcttttgacggttaaagagataataaaatggtaatagataaaaaatcgatgccatcacaccggcaaaatcgcccaccaaactaggtaagctggcaccggtcatgatgaagtggagtaacgaccgaattaccgcgactccgattccgccgattggtccgtagataaatgttcccaataagacaatcacatcactgaaatcaattttcagaaatggaaacgccaaaataattggaaactcgaaaaacataacaataaatgaaatcgcccctaacatcgcgacccccaccattgtccgtacttttgaaacacgcatttagtcatgtcgtgacaattttggtctgtttttatgctttggtttttcatttaattcagcgatctttttgaattctgcgacttcgattggtttcaaagcacggtattcgccagaaactaaaccatctaacgttaagaagccgtatgtttcccgttttaacttagaaacgggtaagccaacagcagctaacatgttcttaacttgatggttcatcccttcatgaatcgtaatacttaaaatagccgtatttttacgacgatccgttgaaatgattttcactttagcaggggccgtcttacgtttttcaagcatgattcccttccgtaattgacggagcatttctgcagttggtaaacctgatactttcgcaacataggttttatcaaccttgtattttggatgcatcatcatgttggcaaagtcgccgtcattggttaatagtaataaacctgatgtatcgtaatcaagacgtccaattgggtaaacacgttcttgaatatcttcaaggtattctgttaccacgcggcgctttttatcatccgtgacagctgaaatcacttggcgcggtttataaagggcataataaacctttttttcacgcgttaatggcacaccatccacttcgatatgagcagaagtactatcaaccttaatccccatttccttaaccactttaccgtttaaagtaacgtgaccagtcgcaattagcgtttcagccttccgtcgtgaggcaacgcccgcatttgcgatgactttttgtagtcgttccatttattgttctcctttaggggccgtctctggtcccgtttcatttaatgtctgttcaaactgacgataatataaatcagcggaatcattatccgattctgtcgtatcgtccgttaatgtcatttgttctagttctggtaattcttttaacgagcctaagccaaagtaatctaagaaataatcgctcgtcccatataaaatcggccgaccaggtgcatctttacgccctttttcaacgattaattgtctggcaagtagcgtttgaattgccccactactttgcacaccgcgcacttcgtcaatttcaattcgcgttagtggttgccgataaacgatgatcgccaatacttcaagtgccgcttggctaatactcgtcgaaacaggaccatcaaaataggccttcaataagcccgcataagccttcttagtcactaacttataacaatcagccgcttgaatcaaactaaggccagattgctcatccgcctgataacgttcagctaatttcgttagtaactgtcgtactgcagcctcatctaacataataagtcgtgcgatgtgttgcagtgtaatgccttcatcgccggcgacatagagtaaactttcaatttcagcgagatggttcattcagcgagatggttcatctgcaataccttctttcaatgtcactaatatctgttcatcataatctgcttgatcacaattaattagccgttctttcatcaattctaagacggctaaaaacgttgtgacgatttcttcgcgatcaaaacggttgataactaactgttcaaaagttgttgttgctcgcgtctttaagcgatcgataatccaatccatcttttcagcaatcgtaatttcatcattttgaactgtcttaaaatcaggttgctgaacagtcgcctcaaccaacattttagacacagcagccgctagatcacggggcttaattacgccacgcgccagtgggaccactttttcggcaggattagcacttgccggtttcgcaaataacaattgtctttcagattctcgttcttgtaagaccgtcgcgattttttgaaaagcttggtatgccaacaattggtctaccaattcctgacgaggatcgacataatcttcctctaaggcttcagccattgccggtggcgctggtaagagtagcttactcttgattttcatcaaggtcgctgccattactaaataatcacccgcaacatctaacttcagttcttgcatctggtgcaagtagtctagatattgcgtggtgatttcagcaattggaatatcataaatatcaattttagtctgattaatcaaatgtaataataagtctaatggtccttcaaaatccgtcaaaattaacgttaattgttcagtcatttaatccatttctttagtctgctgttgctcccatttagcaattaaaggcgccgtatccaatgatcccatgacacggttatcaggataaagtgctgccagttcattcaagatccggaatagattagtatcagttctttcagcgggacttagcgacatatgacgcaccaaaataaaatcagtgccaatctcaactcctacgatgccggagaagtcgccttcatcattttgccaaaggtataagacatgttggtcatcttgattgtaaaaagcaagttctgactgtacatgacttacttcttttaaatctggaataaacgataaaaagcccatcgcaattttttcataatcattcttgtacttaaataacatttagtcacgcggatggcttctttgataaacttccgtgagatgtttcttactgatatgcgtataaatctgggtagttgaaatatcggaatggcccaataattcctggacaatccgtaaatcagcaccattttcaagcagaacggtcgcaaaagaatgccgcagtgtatgcggtgtcacatctttatcaattcctgcggcttggacaatgacttttaaatttttccaaatgccttgtcttgttaacccgttcccgtgaaaattaacgaacaaataaggtgaatccttgcccttggttagccggttacggctgcgttctagatattgattaatccagtccaccgcaacatcgccaattggaataattcgttccttatcccctttacctagggtctgaatcaaccccagagataaatgtaaatccgtcaatttcagatgaaccagttcactaacccgcaaaccagtcgcatacaagacttcaagaattgcccggtcgcgcagacctaatggtgtactcgtgtccggggtctttaacaagcgttcgatctcttctgatgacaaaacagccggtaagtggcgaccttgcttcggtgaatcaatctgtagcatcggatctttttgaatacgtccctcacgcgctaaatattgatagaatttacgcaatgtcgaaatactacgcgtgatactgctttgcgcctttttagccgtcgtttgggcctgtaagaaacccaaaataataaatcggtcttctgtaaaagacgtcaatttttgtgacactaaaaactgctgatactgtttcaaatcttgccggtaactctgacgcgtattttcagaaaggccgcgttcaatcttcagataatgtaaataatcttgaattaaatcatccaactacaattggctaatatccacttgcttacttggatctagctgattggccggtaaaccattagccgaattaacagcttgacagtttgcacaaatcccttgaagggttaagcggtgatctaagaccgcaaatgaaaaccgctcagcaaccgtctgttcgacacttaccaataagtcctcgtgaatttcttcgatggccccacattgtaagcataacaaatgatggtggaaatgctgactcgcattttcttcgcataaatcataatgcgtcacaccatcttccacaaagctaatcttattcagaacgtgtaactcagttaacatctctaacgtccggtaaaccgtcgctaagccaatctctggcacttcggctttagtcttgataaagatttgctcggcacttaaatgcgcctgtgagcattctaaaatgaccgcaacggttgcttctcgttgggcagtcaatttatagcccgcttcttgcaattgttttctgatttgttctaactgctcagccttactcatttaatcttggtcttgatcgttatcaacaattggttcaatatctttttggcctttagccgttaaaattgtttcgccttcttcttgcacgatgaaaccattcttcattaaccggcctaaagcacgcttgaaactccctttactgatcccaaaataactcttaattaattctggattactgcggtcagtatatggcattgcgtagcctggttgacgttttaagacggccataatcatttcggcatcatcaccgatttcttcgtaggctcttggtttcaaactaacgtttaaactaccttctggacgcacaccaattactcggcccttaacccgttggccaagacgtggttctgcttcacgttctgaaggatgaataaagccaatgtagaaatcatctgttaataagaaagtccctgccatcttcaaacgataaacagttccttcaatatcttggttcttcatttcttgtttagcacccttagaaatagctctaaagatattttcgtcggctaattggccccacatccgacctttttgatcaacttcgatggcaatcatcaaacgatcgccaaccttaggccataatttcataattgttggtaacacatcaagtgaaaccacaatatccttatcaggtaagccgatattaacgaaaacgccaagatcacgacgtgtttcaacaacttcaccaaaagcaaagtggccgacacgtgatttaggaatagccgttgataaaactaattcccgacttgaattttcgtatgcaaaaccagtgactgttgccccgattgctaattcttcttctaaatggtctttctttaattcaaacgtcacaccgtctttttgggcgaagtacgcttcttcattctcatctgttacaagtgctgtaatcacttgtccgattaattcgttcatttaatggattggtactaaattgaaaattgttaaaatggtgtaggtgatacctgcagcaatcactggtccagccgcaatccccttaaggaaaacgactcccataattgtgccaaatacaagcgccactgtcatttcgggactagcggctaacaagccaacaccctttgccgacaaaacagcgactaacacgccacacccaacggcaataaaacctgccggtgtcttaaaagcactgattaattctttaaaaccgatttgaccagtcgcaattggcactaagatggccactgaaatgaccgtcacgccccaattaatccctttagactggataaccggtaatactttttcagaaatcggtaatgcctttaagactaaaacaactgcggtggcaatgattaaagattgattttttgctaataaggcaacgattaaaatcgctgctaaaaataaccaactttccatttaaagggcgtttgttgcaccgcggtaaacaataccacgacgtgaatcaacagtaacaacttcgccatctttgatagcttctgttgcgtctttagcaccaacaacaactgggatacccatagcgataccaacaacagcagcgtgtgatgttaaaccaccgttttcaacaacgatagcacttgatttttcgattgctggtaagtaatctttgtcagttgctttaacaactaagataccaccatcaacagctttttcagctgcttctttagcgtttgaagcaacaacagccttgccaacgattgtttcatcgccaacaccttggccttgtgttaattttgaaccaattaattggatcttcataacgtttgttgtgccacgttcgccaacaggaacaccagcagtgatcaagattaggtcgccttctttagcaaaaccatgttcttgagctgtttgtgtagctaagttgaacatatcatctgtattagcaggtttcttagcgataactgggtatacaccatagttaactgttaaaccacgacgtgtacgttcgtcgaatgtaacggctaagatgtcagcttgtggacggtatttagaaatcatacgtgctgtagaacctgattctgtagcagcaacgattgtcttgatacctaagttacgtgcagtatgtgcaacagcttggccaattgattctgtcaagttagtcttgctgtatgctttcaatgcatatgcatcgcggtctgttaatgatttttctgttctttcatcaatgcgggccattgttgcaacagcttctactgggtagtcaccgttagcactttcacctgaaagcattgttgcgtcagtaccatcaataacagcgttagcaacgtcattaacttcagcacgtgtaggacgtgggttttcttgcattgagtccaacatttgtgtagctgtgataactggtttgccaatagcgttacatttcttgatcaagttcttttgtacgaaaggaacgttttcaaatggaatttcaacacccatgtcaccacgagcaatcattaaaccgtctgaaactttcatgatatcgtcaatgttgtcgataccttcttgtgattcaatcttagggaagatttgaacatgttccatgtgtttttcttctaataattcacggatatctaaaacgtcttgaggtttacgaacaaaacttgcagcgataaagttgatatcgttatctaaaccaaaacggatgtcactagcatctttttctgtgataccaggtaagttgattgaaacaccaggtgcgttaacacctttacgtgagccaaccataccatcgttttgaacttcagtaacaagttctttgtttgcttcgtctttttcaataatcttaagatccactaaaccatcatcgattaaaacgtggccaccaacgtgagtatcgtcgtatagacctgggtaagtaacggcaattttttcaggtgttccttcaagagtatcgtccattgaaatacgtaccacttcaccagtgtgtaattcaaatttcttaccttgttgaacagttgtccggatttcagcacccttagtatctaacatgataccaacagttttgcctgtagctttttcagcttcgcgaaccatattcatacggcttaaatgttcttcatgatcaccatgagagaagttaaagcggaatacgttagcacctgcttcaattaattttgtgatgatttcaacactgttacttgcgggtccaagtgtacttacgattttggttttcttcatctagtaagctaaatcttcatttaaatcataaagatctaacattgcgtgatgcttgtgattgaataagtctaacatatcatgtgcgataatttcattcttttcaatcccaagtgcaaccccgcctttaccttcaagcaataattcaactgcttttgagcctaagcggctagctaatacacgatcactagctgttggtgaaccaccacgaacaacgtgtcctaaaacagttgaacgtaagtggaaatcgccgtattcagaaagtttttctgagaattcatcggcatgcataacgccttcagccaaaacaataatagcatgtttttggccatgttcgcgtgaagcacgtaacttttcagcaacggccttaacgtcgaaatcacgttctggaataataatatcttgtgcgccaccggctacaccagcccataaagcgatgtcgccagcgccgcggcccattacttccacaacgaaagttctttcatgacttgcagccgtatcgcgaatacggtcaattgattcaagaactgtgttaacagctgtatcaaagccaattgtttgatctgtaaatggaatatcgttatcaattgttcctggaagaccaattgcgttataaccatgttcagtcaaacgaagagcaccgtgataagaaccgtcaccaccgataacaactaaagcttcgataccgaacttgttgagttgttcaatacccttcaattgtccttcgacttgtgcaaattctggataacgtgctgagtataagaatgtaccaccacgttgaatcttgtctccaaccgtaattggatccatcttgaagatatcaccagcaactaagccagcgtaaccataattgataccatagacttcaaggccttcatgcattgcttttcttgcaacggcacggacggcagcgttcataccaggtgcatccccaccacttgtcaaaatacctatgcgtttcatcttttcaccccaggcaaatattttacttaaaaaaccgatttggtctttcaaagtcacctaactaaagccctttaaaataacgtttgtaggccccagtaaggttgtaagcgccgtcgttaatttttcatcgttcgcaatccaatagcgttcgttcaaaagaattgacttcttcgttgctgaattatagagaattaccgggattggccctcgacttttttcgagtagttggtacattttttgttgctgttcacgcgttaaatccgcagatagtcgtaaataaagcgtggccttaggcaaccctttttgcgcttgttccgctaacataatctgattaccgataagttgcaactcttggcgttgttccgtctttcctgtgactaaaatcacttgttctttggccagccaatctgctacttgccgataaaccgatgcaaacagcgtgacactaatctcgccggtggcatcttgtcccgtcacaaaagccatttgctcgccttttttcgttcgaatcaccttaattcggcggacaaataagactagtcggacattttgattgggtgctaagtcactaacttccggcacgtgatagtaccgacggacacgttcatacttttctaccggatgccctgaaagataagcccccaggtactccgcttctttatccaagcgctccgttaacgtcaaattaggcaccgttttttctttgggtgctagaatttcgaataacgacatattatcgccagctaacttaacactatccaataaatcatcgagattcatcaaaagtgcgttgcggttgggattaaattgatcaaaggccccactgtaaatcaacgccactagcgcctcttttttgagatacttcgcggctagtcgttgtagaaactgtaacacagatttgaacggaccacccgtttggcgctcatccaaaattgccgctacaaaatcccgtcgtaaacccttgatgctgtataatccaaaaataatcccggcatctgtcaccttaaaataacgctgactgagattaatatcgggtggtaagactgatagttgccgcttctttgcttccgctaaatacgttttagtctttgttccttgatttaaaacggcatttaaaaccgctgcgaaaaaggcttctggctggtggacttttaaataagccaaccaaaaggcaattttactgtaagcgaccgcgtgcgatcggttaaaaccgtaattggcaaactgttcgatatagtcgtagaccgttgtcgcggcttgttcggtatgccctaaagccagtgcaccttcgataaacttcgttcgactcgcatcaatcaccgcttttttctttttactcattgcccgccgtaagatatcggcttcccctaaggtaaaaccgcccatcttagaagccgcctgcatgacttgttcttgatacaccaagatgccataagttggttgtaaaatttcagccaacgagtcatccggataggtcaccggcactttgccacttttacgatcgataaatgtatcgatattttccattggccccggtcgataaagcgcatcggttgcgacaatatcttcaaaagaagtcggtttcaagcgccgtaaaacatttttaatccctgttgattcgaactgaaagatgccgtttgtatcaccttgttgaaataacgctagcgttgctggatcatctaacggaatattttgcggattaaaaggctgacctgtttgttggctgactaatttaacaatattcgctaaaatccctaagtttcttagacccaagaagtcaatcttcaacaatcctaattcttcaacgttgcccattggtagttgggttaactcaatttcatcgccaccgctttgcagcgcaacggtttccgttaatggcgcttggctcaacacaattcccgccgcatgggttgaataatggcgtggtaagccctcaattcgctgcgccgtttcaaatagtaagcgattttgttgagaatctgctacgaggttcttcaaagcttgcgactgatcgtaagcttcttggagcgtaatttttaaaacatttggaatcgccttagaccaagcactcatttcaaactgactgaggccaaagacccggccaacatcttttaacgccatcttagcggccaaggtcccaaaggtaatgatttgggccatatgattttgaccgtacttttgataaacgtaatctaaaacctcatcccggcggttatccggaatatccaaatcaatatccggcatattggcccggttgggatttaagaaccgttcaaatagtaattgataccgaattggatcaacatctgtaatccgcagcgcatatgccactagcgcgccagcagccgacccccgccctggacccgtcatgatattttgctggtgggcgtattgcatcacgtcggcgacaatgaggaaataatcggcaaaacccatttcgttgatcacttgtaattcataatccaagcgtgtttgatacgcctctgggatagattgcttgttaaaccgcgcttgtaagcccgcttgactctgttgctttaaataaacggcggccgattgtcctgccggcgtttcaaattgaggcaattgcgcccgtttgaaagataaatccacctgacattgagccgcaattttttgcgtattagcgacggcttctgccaattgtaatgcttcaaaggcggccgttacctgctgcgcatcttctaaaaagtagccgcctgacgcttgcggcgtctggagattgacctgcgtacccgctttaatatgttgtaggacttgaaccgcaaatgcgtcttccggttctaaataccgcacgtcacctaaagcaactaacggtactgccgtttgctgacttaattgtcccaggggcactcgctgttggctagcggcttgtttagcactaatccctagataaagactgtccgcgtcggtaactgcctttaactgctcaatataggtctgtgctggcgttgcatcattttgcaataacaggcgcactaactcgccatcttgacttggtgtgataaccactaattgttgcaatagtgattgaaccgcctcaaatgggactaattctgattgcgtcataattttcgttgaaatttttaaaatattttgataacccgttaaatttttggccagtaaaatcaacggaaaccgttcgtcagtttggaaaagtccaccgacttcaatcgtgatccccaatagcggcttaatatcggctgctttggcagccttataaaaatcaactaacccatagacaacgttcttatccgttaacgctaaactctgatagccacgcgctttggcggctgttactaaatccgtaattttagtggtactttctaagagcgtataggtactcttaacctggagttgcacaaatgccaaatgaaatacgttatgacgcttttttggacgctaatcttcggattcgttgtcggcttcatcggttctaagttagttaaattggactttaatgttcaagcaacgttgactgtctcagtcatctttgggattttactcaacctagtaccccttgttttacctaaagacccagcagcataattattttgtaatgtagatgtataaatgacttgcagaaaagccggtattaaacttaacgccatttgaagtaatggtcttcattgtcgtttggttgctcttcttatttttcttcgtaaacttactgaattcagacatgactttcttagaatccgcaccagttgattgtgcgagtaacgcaaaactcgttccgaattccttcaaagccgccttatccttaagtgctttgattggtgcgattaaagtaagtcccatcacatcttgatcagcaattgcccctcggatcacaacgttatcagttttcaccaattgatgaacgccatcagctggttttgctggtaataattgatcctttttagccgttttagcttgttgcatagctgcttgaacatctttttgcgtttgttggagtgccattaattgggctggtgccaattgaccggctttagctgctgccgcttgtttttgtaagctttgcgctttggcttgatctgcctttgataacgccataccaatgacagcttgattatacttgtcggcaatcgcttggtattgaccaacagcggtgcctgctgccactgtaactttcttttcaatcgtctttgagcccgttttagcctttaatgtgaccgtttgttgtttggttgttgttggtacttgaacaacgtatgtgccttctctaacgcttgttttatgcgttgcgccttggtcaatttgatagcttaagtgggccttcttattagtggtgcctttgacaactgcgaccatcccattttgatggtaatttgttttagaagtcgttaactttgcttggccacagcccgctagtaaactaactaatcccaaactcacgactaatccaactactgtttttttcatttattttaagcctgttttcttttcgtaacgattgaacataatcaatgcgacaactgtaaagaagactggaccggcaattgaccagaatgtttggccaaggttaccgtcgattgcaggttgaataattgtgaagacgttggcgaacccaactgtgaacattaccatccaaacacagaatttgtagaaggttttacccttataaatcgtgaatggcttttcgatactgttatccttcttaaaaccaaagaaggcaaaggcaacgaataagtatggtaatgtcattgaaacgtttgtcattgctgttaaaatttcgaagaacttagcagcactcttaccaccaaaggcaacaaaagcgataattacaattacaatagcagcttgcacgatcatcgcgttaactggcatgttatgtttgttcttcttagcgaatgacttaggccataattcagctggtgtgccttcgataatcgtcttaagaggtgagaagatcaatgtaaagaatgcacctgtaagtgcaaggaacattgaaagacccatataacgacttaaccaaatcccaacttgaattgcagcgtgatgactcatatgaagcgcaagtcctaattggtaacccatgttattcatcgcaatgtaagcaacgttccctaaagtaacttcggcatttgagccagttgctttggcaaaaccgccgcctgttttgaagacgaaatcccagttagtaaatgtccccatcatgaagatcccgatggcataaccaattgcaatcacgattgctgaaattgctaaccctttagggaagttgactttagcattttctgtttcatcaactaacccaccaacaacttccaaaccaccatatgcgaagattgcaaatacaacgaaactaaagacctgaatcattgatgtataactttcgttaggtgattggaaaaaggccttagccgtgattggttgtgctgtaacacccttgtttaggatcaggattaataacccacctaagaataagatcacattaatcaatgtgatggctgaaccaccgatgcttgttacttttttgactttatcaagccctttggatgtgacaaaagtaatcacaataatccaaataatagcaagaattcctaatgtttgcacaccattggttagcccaaagaatgtccaactttgcgtcttatcaaccccgaaaatagcatttgataatggaatccaaatcccgttcccaacgttaaccatccaaatgatgtatgacgcaaaccacatgaaagtcccaataaaggcaaatttagcattgacggatttttccatccaagaataaatcccacccttagcttcaccaaaggcagcgcccatttccccaagcataaatgcgtaaggaataaagaaggttacagctgctaaaacataccaaaaaattgatgcatatcccattaagaagaacgctcgtggaatatttgtaaaaccaaagactgacgtgaaaatcatgagaataagtgcccctaaagtcaacttactcgtctttttcttttctgccacttattttttaccagccgattttaacgttgtcgtttgatcctttttaacggtaattcgaatcgcaatcttataaaccacactctgacaagctaacttcaataatgttttttgggtttcagtcactaagccgttagcaggtttggtcccttgttcaaatggactgtattcttcgtccaattgatgaatcgcatctaagaacgtcaaaataaaataatcatagagttgcttttcgttacgatcagtcgctgtttccactgacagtaagcggccaatttcttcaattgaaaaattagtctttaataacgcaataatcaagacttgtgagatttgttgtttagcatagcgcttcttatccggcgcaacgactaaccccttcttcacgtaattattgatcatcgcagcagtgatttcatctagatccaatacttctaaatattgattgatatagctgacgacttggtccatatataaattcaaacctggtaaatctgtccagcgaggtaattgtaatagttgtagttgatttaagtctcgttttaatagctcattattcatctagtcgttagcttttggtgtaacaacttgttcgcctttgtagaaaccttttggtgaaacacggtgacttacacggtattcgccattagttgcatcgaattgtacgtttggtgtgttcaatttgatatgtccacgacgcatacgtttcttcgtctttgatgttcttcttgctggaactgccatttagtcagttgctttgttttcaaatactaattgatcgtcttttagaccaatttcaactgttgtgttaggtaaaacgtttccggcaataatttctttggccaacggtgtttcaatccgatttgtaatataacgccgtaatggtcgtgccccgaacgctggatcataaccttctttagcgacccataacttagcgtcttcagaaatcgtcaatgtgatttcttgatctgctaaacgatgtgataaatcagccaacattttaactacaatttgttcgacatcttgcaagctcaatggcgtaaacataatcgtatcatcaattcggttcaagaattccggtttgaatttcgtttgaatcaaggcttgaacactattagctgcttcttttgaaatttgaccttgatcatcaacaccatccaagaggatttcagaacccaggttagaggtcatgatgataattgtgttcttaaagtcgattgtacgcccttgtgagtcggttaaacgaccatcatctaagacttgtaaaaggatattgaagacatctggatgggccttttcaatttcatctaacaagacaattgtatatggattacgacgaacagcttccgttaattgaccgccttcttcataaccgacataaccaggtgccgcaccaacaagtcgtgatactgagtatttctccatgtattcactcatatcgattcggaccatgtgtcgctcagaatcgaagaggtcttcagctaaagctttagctaattccgttttaccaaccccagtagggcctaagaacaagaatgagcctaaaggtctattagggtcttgcaagccagcacgcgctcttaaaacggcatctgtgaccgcatcaacagcttggtcttgaccaattacccgttcgtgtaaatgatcagctaattgtaatagtttttgccgatcacctgctactaatttagcgactggaatcccagtttgcgaactaacaactgttgcaatttcgttttcggtaactgattcttgaaccatccaatcctctggtttttcagccttttcaaggtcagcaagatcttgttccaattgcggaatggtggcgtgttgcaatttagcagctgtttccaaatcgtagttactttgggcatcttctaattgccgttttgcttggtccaattcttcctttttgtcgttaatcttgttcaaatcagctttttcggtttcccaacgcatcttcaagctattcgtcgtttcccgtaaatctgctaattgtttttgcgtttcggctaaccgtttttgtgaagccgcatccgtttcattcttcaatgccgcttcttcaatttccaattgcattaattgccgcgttgcttgatcgagctcagtgggttgcgaattcatttcaacgttgatattagcactcgcttcatcgactaaatcgattgccttatcaggtaagaagcgatctgtgatgtagcggttagataacgttgcagccgccactagggcattatcatggatacgaacaccgtggaaaatttcgaaacgttcctttaacccccgcaaaatactaatcgtatcttcaacggttggttcttgaattaacactttttggaatcgtctttcgagggctttatctttttcaatgttttgacgatattcgtcaagcgttgtcgcgccaatcatgtgtaattcgccacgcgctaacatcggtttcaaaagattaccggcgtccatgctgccttcagtcttcccagcaccaacgattgtgtgaatttcgtcgatgaaaactaaaatccgaccttcactcttcttaacttcttttaagaccgcctttagtcgttcttcaaactcaccacgatatttagcacccgcaattaagctccccatatcaagtgagacgatggttttatcctttaagttatcaggcacatcttttctaacgattcgttgggctaagccttcaacaatcgctgttttaccaacaccgggttcgccgattaaaactgggttattcttggtctttctagaaagaatccggatgacgtttctaatttcttcatcccgaccaatgacgggatccatcttaccttcacgaacagctttcactaaatcagtgccgtatttttcaagcgcttggtagttatcttcttggtttttagatgtcacacgctcgcctcctcttaatttggtaataatatcttttaattgtttagtcgtgacgttatttttttgtaaaaattgtactaacggattgtatttagacttcatcaaccctaaaataaccgtttcagttgataaaaattcatcttgaaactcttgcatgtaagtttgagccgcgttcaaaacttgatagagattttgtgaaatattttgaccatagtttgtttgaccttcaactgttggaatcgtatcaatctcgcgatcaatttcactttcaagtgcggttaaatcaattcccgcttcctgatagatttgccgacccagttgttggggttgaattaaatatttaaataaatgtgggacatcgatttctgtttgatgacgcgtttttgcaatattttgtgcttctgcaattgcatcttgaacagcttgtgtcatttgttctggattcatttaaacttcttttgattgcattaattgcttcattttggcattcatttcgtgtaattcagcctctttatcagccaataatttatcatacgttgctttttgcttaacttgttctgcttcaactgcggctttgatttttgcttcttgaccttgttctaaatctgctttttctttagtccattgcttttgcgccttacgttggctcaatgaactcccagttgcggctaagaatgtgataatcgcaccgattaaaagcgacacaacgatcacgataatcaagggccaatcaaccgttgtaaagccaaaattaatggcaactggattaacattcaaaacggcaaaaaccaccacgattagtgcgagaattaaaattgtaattaaacgaccttgctttttcatctatttcttattaaacaaattaccagcgacgtagtcaccaatatggggtgccaattgataaaattgagcacctagtgacatcaaccacggtgcgttaatttcgcgcttaggatgcccaatagcccccacaatcttgtgtgcgagttgatctggatcaagcacgatccagttaaccgatttaagatagttaccagtttgatcagcaatatcaaaaaaggcggtatcaatcggtcctggattaacagttgtcacttgaacaccaaatggtttcaattcaagccgcaatccgtttgagtagcctacaatggcaaacttagtcgctgaatagattgctgatttaggtgtcgccatcttaccggccattgaggcaatgttaatgatgtgcccacgttgtttttcgatcatctgtgatccaatggcccgcgtcaaatacatcaagcctaaaacgttcactctaaacatctgttccaccaaaggcatcggtgttgctagcgcttcttcaaaatgaccaaacccagcagcattcactaaaacatccggtatccccacttctgttgttaattgcgcaacaactgcttcaatcgcttctggggaactgacatctaattgataagcataagctgcttggcctgagagccgttgacattcgtcacgaacctcttccagagctgcttgacgccgtgctaaaacgacgacaatggcacctttgctagctgcttcataggcaattgcccggcctaaacctgacgaaccccctgtaaccaccacaatcttttgttttaagtcttgtaatgctgctaaattttgcatttactccttccgaccatgaaatggaatatcatacaaatctaaatcgctaacgacacgcgtatttttgaaaatatcgcgggcatcattttgtaattcacgcacagcttggcctaaataacgggctgaaatatgcgtgagtaataggcgtttgacatgtgctgttttggcaaccttggctgcattgatattagttgaatggtagtattgacgcgcaattttttgttcttgcttgccaaatgtactttcatggactaaaacatcggcgttttcggctaggcgcgtaatcgcttcacaattgcgggtatcgccaataatggtcacaatccgtcctttttgtgcgttaccgatgtagttacgaccgtcaatttcgcggccatcactcaatgtgactgtttcaccatttttaatccgggcataaacgggacctgaagggacaccgtcagcttgtagtttttcaacctgtaattcaccaggatgatctttttcaacaattctaaaaccgtaacttgcaatccggtgatccaattttgcacattcgacccggaatgttttgtcatcaataatgacaccattttctggtaatacaacgaacttcaaggcatacgttaagtgactttcggaaagttttaaactcgtccgaacgtattcttctgttcctttggggccataaatcgtcaacggttcgtcgccaccttgaaatgaacggcttgataagaagcccggtaacccgaataaatgatcaccatgcaaatgcgttaaaaagattttcttaactttccgtggttttaacgttgttttaagaatttggtgttgcgttgcttcaccaacgtcgaataaccacacttcattccgttcatccaataattttaatgcaatactcgtgacgttacgttgacgggcaggaacacccgcaccagtaccaagaaattctaattccatttactgcttaactaacgcttttgtaacgatcgccgcatattctttcacaccaaccggattaggatgcacttggtcatcatagaaccagtcaccgtgttttcttgcttgatcgtaccaattaataatcgttagatttggatacttcttagcggctcctttaagcatttgattaacatcattttgccaaggccgcgttggcacgtatgcatttagccagaacactttgcgttgactaccaatggcagccataaattcatctaactgcgcttgggtaaatgagccgttggttcccaaactaattagaaccgtatcgctaagcgcgcctttttgggcgtagctatcaacaactggcgtactcttgttcaattggcgaccgacagaggcatccaccaacatattagggaacagtgtttgcaacgttttaccagcatcgagcaatacagaatccccaattgctgtaattggcatcgattgggctttttgcaattcaacctgtgttaacccgtacttctcatattcttggttaactgggtgtttttgagccgctgcttcggcctctttatcagcttgtgcttttgatttagcctttttctgttgcttattttgagccttggccttttcaactaaggctttattacgagcatcattttcttttttgttcttttgaatattaaccgcaagtgccgatttatgagcatccggcgctggttgccccggtgcttgaatcgcacctacaaggcccactaaaaagacaattgccatcccaaaaactaaaccggattgccgatttaacgttgggtgtttaacaaattgacgcattctctgccctaattcttgatatggataatgggccaatggttgttcaataaagcgatatgacaattcagttagtccgaaaataatcgcgacttcgatcactgggtataaagccggatgtgcagaaacatttttaaagacgccctcaaagaaaatcatcactggaaattgatacaaataaatcccataactgcgttttcctaaccagttaaagactggattggttaataggcgattccaatctgaacctggatgtgcaacaactgctaccaagacacagattagtaaactaaagatgaataagccaccccgataaacaaaggcactttctgcattcattttgaccattaagatcaacattgtaatggtgctcaaaagaccaatgccatctaaggtccatcgttggcgcggaataatcttttgtttcaaagctgtcgatggccagacaaaagctaaagcagcccccaccaagattgagaacatccgagtatctgtcccatagtaaagccgacttggatccgcatttggatgatatagaatggccatccagattgccgaaactaaaccagcacctaataaaacacgggcaatccggcctttattcttaaagccaataattaatgcgacaacgacaaacggccataacagataaaattgaccttcaatcgaaagcgtccataaatgtgtaaagggtgattcattattagcaaaccgatcaaaataagattgaccatggccaatttgccaccaattataaacatacaaaatattagtgataataatttgatttaagttatgcaacatctgccgttcaaataaagtaatatacgcacctgtcgcaaacaacatcgtcaataaacccggatagagtcgcttaacacgtcgtaaataaaaactcttcaaattaatccaatgattttgttcccattcttggaccagtaaatccgtaatcaaatagcccgaaaccaccatgaaaatcggaacgcctagataaccacctgtaaaagtgtacggcatcaaatgatacaaaataactccgataaccccaatagcccgtaatccgtcaaacccagtaatataacgactgttatttaagcgctttttccctgccatttattcgacaaattcaaacgtaaagttatcaattgccactaaatcgccatcatgagcgcctttttcacgtaatgcttcgtcaagtcccatagaacgtaattgacgggcaaaacgcatcacaccatcttgatgatctaagttactcatcttgaagagacgttcaaccttttcacctgtgatgtagaacgtaccgtcttcatcttgttcgacgttaaaggctggtccttctggttgatattgataaagtttttgtgtttgtgcttcttcaacatcacccattgggaattctgctgtttcagctaataaatcggctgtcttgttcatcaatggttgaacaccttgatgcgtaatactcgaaatttcgaaaatctcatgtgtatcaccagccgctgctaatttttgtttgaattcagctaataattcggctgagcctggtagatccatcttagttgccacaatcacttgtggacgttccaagatttttggatcatatgattctaattcatgattaatttgttggtaatcttcatatggatcacgaccagtttgatcgtccatttcgattaaatgtaaaacaactcgtgtccgttcaacgtgacgtaagaattgaatccctaaaccaacaccatctgaggcaccttcgattaaccctggtagatcggctaatacgaaatcacggccatcatccagttgaaccatccctaagttaggcaccaatgttgtaaattggtagctcgcaatcttaggtttagcacttgtgacaacagaaagtaatgttgatttcccaacagatgggaagccaactaacccaacatcagctaagactttcaattcgagttgaatgctacgttcctggcctggttcgccgttttcagcaatttcaggggcactattcttagcggttgcgaaatgcatgttgccacggccaccacgaccgccctttgcaatcactaattcttgaccatcttccgttaaatcgcctagcaattcatttgtgtcggcatcacggacagttgtaccaggtggcacttggacaaatgtatcttcggcaccgcggccatacatttgtttattctgaccgttaccaccactattggctttaaagtgatgacggtagcggaagtccattaatgtccgtagaccttcatctacgactagaatgacactaccaccacgaccaccatcgccaccggctggtccgccaagtggcacaaacttttcacgacgaaatgcaacagcaccatcgccgcctttaccagctttcacatcaattttgacttgatctacaaacatttattgtacattcgggattaatttaaatgaactccaaggttttaaatattttaataagaataattcatctggtgcaatatggcccacaacgtttacccgaccatcatttggcattgcttgaagcgcaatttgggtttcgcctttgtattggccgtagccaacattgtcaatcaagatatcgccccgttttatatcaactgtattgtgggctgcaaatggtaagtctttataaatgacccgcgtcattgttgaacgcaggatgtattcagaacggtcaccacgataactgtgtaagctttcaaataacactttgcgttcatcagccgtaatatcgtcagccacatcaatcataatcgctgggaattctgcattaaagaccgtttgcattgtttttagttccgcttcggaagcatacgcattgccaacaatgatgtcatcgatattatccattaacatgtaatgtttcatttgggtcgccatcgctaagtcccgatcaacttccatcgttggtaggccatcttgtgttggccaaggtccgaaagtcgcttcatgtgaattaacgaaagcagccgtatttaaattatactgtgcaaattgcgctgtacattggttaaagaagtcttcccctaaaccggaataacgatgtggatagaagttatggcagcccaataagttagcccgtttaggtgaaaaactcataatattgtcaacatagcttgtcccttgactcatattaatttcgattttaagatcgtatggattacgggtcatcttcgcttcttcttggcctgtaaacccgttatctaaccgaatcccccaagcacctaattcatggaagaaacttaaatcatcataggaaataccaagttgttcaaacaaaccaggattaatgtcaatcatcacttgcatccctaattgatttgcataatcaaccacgcgcttgaaattagtaagcaccgcatcttgatcaccactgacttctaataatgatgtgaagactcgtttaaacccgtattgatgtgcaaggtctagataagccgcatccttttcaaaagttgatcgttctggataaattgaaacgcctaattttcccatatgttaacagaagaacggcaccaagccatcctggatttattacaacaacaagatgtcgtcaaaatgaaagcgttatgccgcttattagacgcatcagaatccactattcgtcgtgaccttcaacttttggaagaacaaggattggtcactcgaattcatggcggtgctaaacgcctcaataaattacaggttgaattagggcaaatcgaaaaaacgagcaaaaacgttcacgaaaaaaatgaaattgctaagtttacagcttctaagattcaattagggtgcgtcatctatctggatgccggcacaacaactcaagcaatcatcccttatttaacacctgaaatgaatttaaccgttgtaactaacggtgttgatacagcttcacttttagctgatcatcatattcaaacctacctattaggtggccgggttaaaaataagaccaaagcgatggtcggtgcgggcgccttagaaacactgctccaatttcaatttaaccaagcgattttaggaactaacggtgttgaccaatattcaggtttaacaacgcccgatcctgaagaagcaacgctcaagcgattcgcgattcaacaggctaaccaaacgatggtcctagctgatcatacaaaatttgatgccgtttcatttagtaaatttgccgaacttacgcaagttcaactgattaccgatcaactctcccctgcactacgtcaaacttatcaaacacatacagatttacaggaggttttataggtgatttatacgattacggcgaatccatcaatcgattacgtcatccaacttgaaaaactaaatacaggtaacgtcaaccgcgttcaatctgacgtgaagctacctggtggtaaagggattaatgtttcaagaatccttgctgaattagcactccctagtgttgcgctaggttttgtcggtggcttcaccggtcaattcatccaaaacaaactcaataatgcatctattgactgtcgcttcacagaagttgaagaagatacacggattaacgtcaagttaaaagatagcgttgaagaaactgaaatcaacggccaaggccctcacatttcagctggtgctgttgataacttgaagcaacaactggctaaattagaagccggcgatatcgtcttcatgtcaggcagtttgccacctaacttacctgctagcttctataaagacttgattccaatgattcaagcgaacaatgctgaattcgtaattgatacaactggtcaagccttattagatactttagctgaaaagccattggtgattaaacctaaccaccatgaactagccgaattattcgacacgcaatttgctaaccaaggtgaaatcatcgctgccggacgcaaattattagacaaaggtgcccaacacgtactggtgtcaatggccggtgatggcgccctcttaattacaccagaccacgcttatctcggtggcacccctaaagggactgtgattaattccgttggtgctggtgattcaatgattgccggctttgtcgggacattcgcgcaacatcacgatgcactagctgctttcaaaacaagtcttgcttgtggcagtgccacagccttttcagaagatttagcgactagcgctaggattaacgaactcttaccacaaattgaaatcacacaagttgattaaatgaacatccaagatttactcttaaaagatgcgatgatcatggatttacaagcaacgactaaagaagccgctgttgatgaaatggttgcccgctacaaagatatcggtgttatcacagatgataccctttatcgtaaagatattttggctcgtgaagcccaatcatcaactgggattggcgaaggcattgctatgcctcatgccaaggatagcgctgttcaacgcgcaactgttttattcgctaagagtcaaaatggtgttgaatatgacgcattagacggccaacccgtttacttgttcttcatgattgctgctccagaaggcgctaacgatacgcatttacaagccctagctggtctttcatcacttttaatcaacccacaattagtggctgatttgaaactagcccaaacacctgaagatgttcaagaactctttgctaaggcccaagcagccaaagatgctgaagacgctaaggaagaagcagaagaagctgctaaagcacaagccgctgctgcaacacctgctgatgaacaaaaaccatttatcgttgctgttacagcttgcccaactgggattgctcacacttacatggccgaagctgctttgaaagaaacagctgctaaaatgggcatcgatatcaaagttgaaacaaatggttctgaaggggttaaacaccaattaacagccgatgatatcagccgtgcaacaggtgtcattatcgctgctgataagaaagtcgatatgcctcgtttcaacggcaaacatctcttgaaccgccctgttatcgacggtatcaaaaaacctgccgaattgatccaaaaaacattggatgaagaaggttcaatcttccatgcaacagaatcacaagcaagcgaagaagcttcagctgataagaaaacactttggagccgtatctaccaagatttaatgaatggtgtttcaaatatgttaccattcgttgtcggtggtgggattttaatggccatctcattcctattggaacaaacagttggcgctcattcaacaacctttattttcttgaactcattaggtaataatgcttttaacttcttaattccagttcttgctgcttacatcgcgatttcaatcggtgaccgccccgctttaatgcctgggtttgtcggcgggtatatggccagtcaagcaacagctagtgtgatttcttctgatagtcctgccggtttccttggtggtttagctgctgggttcatcgctggttgggtcatcgttggtttgaagaaagtcttcaagaacttaccacaaacattagatggtttaaaaccaatcctgattttccctgttcttggtctattgattgttggctttatcatgttctttatggtcaacccagtcttcgctcaaattaatctctggttaagcacattcttaacgcacttaggggctggcaatgccttattgcttggtgcgattttaggcggtatgatgtccgttgatatgggtggtcctttcaataaggccgcttataccttcgcaatcggtgtcttcacaaccactaaagatggctcattaatggccgctgttatggctggtgggatggtgccaccattggcaatcgcggttgctgcaacaatcttcaaaaacaaatttacgggtagtgaacggaaacaagcctttgctaactacgtcttagggatttcattcattactgaaggtgctattccatttgctgcaacagatccattgcacgttatcgtttcaagtgtcattggttcagcaatcggtggtggtttaacccaattatggcaaatcactgttccggcacctcatggtgggattttcgtagccccacttgctaaccacggtttactctttgtccttgctgtattaatcgggacattcatcagcgctttgatcttaggcctctggcgtccagttgctaaagaatcttaattaatggctatttagttgaaactttttaaaatgtgcccggagataacttaacgttaagctttcagtctgtgaagcgaccaattcagatggcgttccactggccatcacttggccaccttggctgccgccttttgggcctaaatcaattaaataatcagcattcgtcatcaaatcaaggtcgtgggtaatcataatcaccgttgcgcctttggcttttaattgattaataacgcccatcaaggtttccacatcccgtggatgcaagccaacagatggttcatcgaagacgaataacgtcccggcccgttttttattcaaatgtgtcactaactttagccgttgcgcttcgccacctgaaagacttggcgtactttcaccaaggcgcaaataccctaagccaatctctttgagaatcttgagttcttttaagatgttaggtacgtccgcaaaaaccggtattgcttcttctactgataaggccaataagtccacgatgctgtcaccatgccacttaatcgcctcaattgccggcttataccgtttaccctgacattctggacaaacttcttccatatctggtaagtattgaatatccaaaataatactgcccagaccaccacaattgggacaggcgccttctttattgttatacgaaaaatgggcaatcccataattgtgagcttgcgattccggtagcccagcaaataatttccgaagattcgtcatgatgttagtataagtggataaagtcgaacgcgtgtttttaccaactggcttagcatcaatgctgacgactgacgttaaatcggtcgtcaactgggtcacctgttggggaagttgctcatgcttatggtgagcctcaatcgccggtaccagactatccaagattaaactggtcttaccggcccccgagaaaccagaaaccgccgtaatttgattatccggtatttcaatggtcacatcacgcagattaaaatactgtccaactgtcattgtcgttcgaacacccgtagcttgcgttgcaactttggggtacaaaatattgggtcgaccggcaatgtatggtccaattaatgattgtgggtcttgcactaaatcggccggcttgccttgtgcaatcacctgaccgcctttgcgccctgccgccggaccaatttcaatcacccagtctgcttggctaatgatgttgacttcatgatcaacgaccactaatgaattgccctgcgccactaactgtctgaaaatatgaattaaaccttcaacgttatccggatgcaacccgattgacggttcatccaagacatacaaaacaccggttgttgccgttcttaaggtccgcgctaattgaattcgctgaagttcgccagtcgataatgtgttcccattccgtgacaacgttaaatagtcgagtcctaatgacagtaatggctgcaacgtttctaataagttcttaaacaaaatggttgccatttgttgcatctcgtctggtaaatcggctttagtagccgttacccaagtgtctaatgcccctagcgtcatatcagaaactgccgcaatattttgcccgccaacggtttgcgttagtagttcgggattgagccgtgtcccgtgacatgttggacaagttgaaaaatgaaaaaaagaattgatcttggccatcgcacgatcacttttgaccgattttaaagattcataaacggcgtcgtaggcattttcatagagtgtattttccgtactaaagacgcgaccggttgatgtgtgaaaatcgaccgcgtatttattccgcttaccatgcaagacgatttctttttccttggccgtcaaatttttatacggtacatcaattcgaaccccgatatgtgcggcgaccgttggcataaagttccgccccggtaaacgccaagaagcgattgcgccgtcttcaatactgagattttcatccgcaattattttgcgatcatctagcgtttgaatttggcccgtcccatgacattccggacaggcacccgctgaattaaaagcaaagtcctcagctgatttagccataaattctacctgacaagttggacaggtaataacgcccattttatcgccagctaaatccatcgcttgcgcaatctgcaaactaggttgaatcttatgcccgttcggacaacgcgtggtgcctaaacgtgaaaaaattaaccgcacaacattaaaaatttcactcatcgaccccactgtcgaccgttctgaaggaacactggggcgttgtcgtaatgcaattgccgatggaatatgccggacttcttgcacttgcgagcgtttattctgtgtaatacgccgccgtgtgtaagtcgagagtgcctctaaataacgtcgcgagccctccgcgtataaaatgcccatcgccaatgaacttttacccgatcctgagggccccgaaatcgccacaaattggttcaaaggaatatcgacattaatattttttaagttattgacgttaccgccccgcacttcaatctgtgttggttgtttaactgtcatttatagtaactgttttaattgttccgcttgcacactacggacttcttctacaacaaccaacgctttgacatcgatttgtgagacaaccggtaccaaagtggcgagttgtttcgccgtacaaatgacatacaacatcggccgctcattttggctgtaataaccttgggccttgataattgtaatcccttgttgaaactgcgtcgacaacgtttcagcaatcgtttcgtattgatctgaaataatcgttaccgcgcgtttagccccaaatttagccagtagtttattcaaaaccactgctgataaatacaattcaataatcgttaagagcatattttgaaaaccaatgatcaagcccgacggaatggcgacaattaaatcgaaaaagagcatcgcagacccattcgggattcctaaatagcggttaacgatcttcgccagaatcgtactaccggcaattgtcccttggcaatgaataataattgccattgcaatccccatcaagacgccaccaatcaccgttggaattaaggtttgcgtcgtatgatagccgataaaatgcggtagcttcaaaaagagtgaaatccagattaccgcccaaactgaataccagattgtttggcgctcaaggtatctaaagccaattaccactaataggccgtttaagatcagattcgtaaaggccggtggaatggcaagtgcataataaccaatcgcagtgagtcctgtcacaccgccctcaccgatttgatggggaatcaagaaatcattaatggcgatggcataaataaaggccccaatgataattcccaagccgttttttaaaattgcttttttctgcatttatttaataatacctaaatcgatcatcgattgaccggttgcaataatcgaatccgctgccgatcttggttgccaacctaaaagctttttagctttttcattacttgtatcggcgtatttacccactaaagtcgctaacattcgtaaatccggtttgaatgtcgctgctagcttaataacactattgggaattgtcttttgcggtaaccgacttgcgtattgtgggaaagcctcacgtaagacatcggccacttctaacatagataatgtttcaccagtggttgctaagaagcgttcgccatctgcttgtggcgcagtcatcgctaataggtgtaagctcgcaacatcacggacatcgacgtaccctgattttatttgtggcacagccttaacttggtcatttaacagttgttcaacttgcacgtttgaatgcgaataaacggatgataaaacagggcccataacaccaaccgggttgacagctgctagtgataagccttgcccttcagttttaatgaagttccaggccgcctgttcagctaacgttttcgatttttgataagggtgaatatttttagcacttaaatctgaccagtcggcttcagtgtaaggcgtttgttgattaggatgccccgcacagattgccccataagcagaggttaacacgacgcgcttaacatccgcatcgcgagcggcttttaaaaccattaagacaccattcactgccggattaatcatttcagattcatccttgaaatttaatttagacgttggtgaggccacatgcatgacgtaactgatcccaaccatcgcagccggccattgctctggatgttgcaagtcggcttccacgaacgataaatcttcaatattggtaatcccgtttgcttgcatgctggtgataatccgttggctcttggccattgaacgcaccgttgtccgaacggcgtagccctgttctaataattgtaaaataatatgtgatgcaataaaaccactcccaccagttactaatactaattctttcatatggcagcaactaaccatgcccaagcaatcaaacaagattcccaagaatacctcactaccgcattattacaactcctagaggcccatcaatttgaagatattacggtcacccaagtcgtgaaacgtgccggtgtcagtcgaatggctttttaccgcaactttgattcactcgaacaggtcttaatcgattattttacaccaattatcgaaacacacttcaaggccgtcttacagcaacaatccgcggaacttaagttagcggccctctcaacattttttatcgaattagaagcaaccctaaaactggcagccaaacgcgggttcgaaccaatcgtccgcgacgtcttcacggacaatattcagcagttttatcaaacaattgacccctggcggtcactggatgcgattcggcaaaaatattacgtgcaattcatggcggttggtgtctaccaaatttggcgtgattggttactgggcggacaaaaagaacccttatcatttattcatcaactattagcaaatctacaacatcatatggacctggctgttagccaaccattagcggattaattatagtgataatttaatggtttgcgcaactgtcttcgagattccgagtgcttcaagttcttcaacagacgcatctttaatatgcttcatcgagccaaaattcttcaagagtttcgtccgcgttttcggaccaacgcccttgatatcatccaacttagaactcaacgaattcttaccacgcaactgacgatgaaaactaatcgcaaagcgatggacttcatcttgaattcgcgtcaataagtaaaagccctgactcttaggatcaagctgaatcgtttgatcggcttcaccaaataataacgaagctgttttatggtgattatccttaaccatccccgcaactggaattgtgagccctaattcgttttctaagacgtctttggcggcattgagttcaactaccccaccatccattaaaattaagtcaggcagcgctttgccctcttttaacaagcgtgaataacggcgatagatcacctcgcgcgtattggcatcttcgttggcgccggcgcgctctgccgtctgggttaatttatacttccgataaagcttcttctcagcgcggccatcaacaaatgtgaccatcgccgacaccggatcggtcccttgaatatgcgaatgatcgaatgcttcgataacatgaccatggggtaagccgagtgcatccataatttcatcttgcgcaccaaccgtcttgcgattatcgagttccaataagcggaacttttcttctaataccagacggctatttttttgcgccatttccatcaaggcttttttctctccccgttgtggcgttcgaatcggtacttgcaaaatatcggataagacttgtttttcgatgccatctggcacgagaatttctcgtggtaacacattattcttacggttataccattggagaataaaggtcgccaattcttcttccggcgtattcacacatggaaagaggcgtttttcccgccgaattaaacgtgcttggcgaataaagaagatttgaatcgacaaccagcctttatccatgtaaaaggcaaataaatcacgcggtgtatgatcgttagaaataatcttttgtttttcaacggttgcttcaatatagcgtaattgatcacgcaactcagcggcccgctcaaattgcatctcctgggcggccgtcgccattttctctgttaaatccttcttaacattgtcaacttgcccgtttaaaaagcgtttaattttcttaatctgttcggtataggctgcttctggtacttcctggaaacaagcacccaagcactgccccatatgatagtacaaacaagggcggccttgatggccctgacagcgccgtaaggggtaaacacgttgcaagaagcgtaaagtctcctgagccgcataaacgtccggatacgggccaaaataatagccaccatcttttttgacatcgccagtaatcaataagcgcggatcacgttcattggtgatcttgatgtacggatagcccgtcccccgttttaacttgatattaaagtagggttggtgcttttggattaacgtaatttccaacaaaaaggcctctttatttgtcgatgtaatgattgtttcaaaatcgacaatttcagagaccaatttggccgtcttaccttcgtggctactcttaaaatatgagcggacccggttcttaagattcttggccttccccacgtagataatctgtgcgttaatatctttcatcaaataacagcctggtaaggctggtaataaggctaatttatgttcgatatgttcacttgccaattattgcgctaaaattttggctaggaattgttgggtccgttcttcttgcggatgttcgaaaagttgcgttggtgtccctttttcaacgatttggctatctgccatgaaccaaacttcatcagctacttcccgtgcaaagcccatttcatgggtaacaaccaccattgtcatgccttcttgtgccaaatcttgcatcaccttcaacacttcacccaccatttctggatcgagcgctgaggttggttcatcaaataataagacatctggtgacatcgcaagtgctctagcaatagcaatccgttgcttttgaccacctgacagttggtcactataagcatcggccttatcggctaatccaacccgttctaacaactgttgtgctttttttgttgcttcttcttttgattgacgtttgaccttttgtggtgcgagtcttaggttatctaaaaccgttaagttggggaacagattgaagttttggaaaaccatccccatcttagtccgcatttggtccaattgtttttcagagagactcatcaagtcggtcccttcaaaaagaatttgaccactcgttggttcttctaaccggttcaaacaccgtaataaggtactcttcccaccacctgaagggccgatgacaacgatcacttgacccgcttcaacatcaccactaaccccgttcaaaacaaggttatcgtcatattttttaactaattgattaattttaagcatttaagcatgttgcatcttcctttcaatatggttgagtagtttcgaaagactaaaggttaagataaagtagatgaccattgcgacaaagattggtgcaacccctttgtaggttgctgattgaaccacttttaattggtaaatcaaatccgtcacaccgataattgaaacgattgaactttccttgattaatgagataaattcgttgcctaaggctggccagatgttcttcaaagcttgtggtaagatgatataccgcattgtatcgtgttgtgagagccccaaacttcttgaagcttccgtttgaccagcgtcaatcgcgttgatccctgaacgaataatttctgcgacgtacgcagcactgttaagcgaaacggcaatcacgccagcgaataaagctggaatattaacccataacccaatcccgaagtagacaaacatgatttgaatcatcaatggtgtgccccggacgaattcgatatacatcacggctaggctgtggaatagtttattcttagaaagtcttgcaaaggcgagtacaaccccaatgaagatcccgataatgattgaaataattgtaatgaataaggtataaccaatccctttagcgaaataagaccagtagtgccacatacttgtattgtgcgtgttcgttttcatcaaactacccgcactctttaaatattgcggaattaatttttgttgcttaatttgagcgatactcttattagcggcagcgactaaagttggtgagttctttggaaatgcaatcgctgaaccttgcatatctgcccctaagttaaatttaccgtcgatttgaactaattcaggatcattgctggcataagcagttgccactggttcttcggccacaatcccgtcaattttatgactcttaagtgctaatactaaatcgggtacttttgttaaacctgtaatctgtgcatttttaatttgttttttagctaatgtttgttggagactcccagtttggaccccaaccttcttaccgataaaactattttttgatttataaatcttggcgtcggccttattgacgaggatcgattgaccacctaagtaatagacatccgagaaatcgacactcttagtccgttcatcagttggtgacatcgctgaaattaccatatcgaccttgccagtttctagaccaactaacaacgcgtcaaaatccattgacttgatcactaacttaacgtgtaaatcgtcagcaaccttttgtgcaacgtcaatatccatcccaacggttttatttttgccgtttttattcactaaaaattcatacggtgcataatctgggcttgtccccaacactaatgtcttcttagcttgaacgcgactaaccgtctgccccgcggctgatacagcttggttattccccactaatagcgctaccagcaaggctaatggtagtaaaatgaatgctaaactttttttgatagtcatatgggcttaaaagtaacacgtcaaacagatttaactagtttattcgacaaatttgcatcaattcccggcgatcgggaaaaaatggcagctgaagttgaagaaacggctgaaaaattaaaagaaacggaatcaaagacaactaaaaaagaataattattctgcgtgtcgttctggataacgttctttaagcttttcaatattttcttgtgctactttttcaaagtcgacgttattccattcagcaatctgtgatagataccagagtacatcaccaatcttcttggtaagtacctgttcatctagttggtggccttggaatgtatattttttgacaatatccacgacttcgccactttcgctagctaaacctaatgccaagttcgttaaaacttgttcattaccatatagcgttctgttcgctaatttttggtattcattaaattccatttaacgacgacctccaatatcacattgttgttcgatccattcccagacagtatccttaccagcaccagtcaacgcactgaagcagacaaacttatcaactgggttaaaatcaagtgcctctttaatgatcttttcttggcgattccatttcccagttgagattttatccatcttagtagcaaccactaaaactggaatatcgtaatacttagcgaagacatacattgcgatatcgtcatcagttggttcatgacgaccatcgatcaatgaaattaagccgcgtaaattatcccgattagtgagataagcctcgataatttgcccgaatttttcccgttgtttcttagaaaccttcgcatagccataaccaggcacatcgacgaaataaagttcattttcaacacggtagaaatttagggtttgcgtcttccctggcttactagatgtccgtgcgtaactcttacgattaattaacttattaatcaaagaagatttaccgacatttgagcggccagataacgcgatttcaggtaattggtcagtggggtactgcgaagcagctaccgcactcatcaccatttcaacttcatgtacttccatttatgacgcttcttgaccatcagctaagaaaagttgtggtttagcagtgccatcaacggcttcttttgtcactaagactttgacaacgtcttcgcgacttggtacatcaaacatcatatccatcatgacttcttcgatgattgaacggaggccacgcgcaccggtattacgttcaattgcaaggtgagcaatcgcatgtaatgcttctggcgtgaattctagttcaacatcgtctaaagccatcaatttactatattgtttaactaaggcgttcttaggttccgttaagatccgaactaagtcgtcttcagttaatttttcaagtgcagccgtgattggaatccgaccaatgaattcagggataatcccaaattgcattaaatcttccgtcacgatttgttgcatcaagctttgattttcatcaaccgcttggccagctttgctaccaaaaccaatcgtcttttcacctaatcggtttttaacgattgtttcgatgccatcgaaggccccaccaataatgaataaaatattagttgtgtcgatttgaatcaattcttgttgtgggtgcttacgtccgccctgaggtggcacgctagcaattgtcccttcaagaatcttcaagagtgcttgttgcaccccttcaccagaaacatcacgggtaattgagacgttttcgctcttcttggcaatcttatcaatttcatcgatataaataataccccgttcagcgcgatcaacatcaaaatcagcgttttgcaagagcttcaagagaatattctcaacatcttcaccaacataaccggcttccgtcaacgtcgtggcatccgcaatcgcaaatgggacgttaaggatccgtgctaaggtttgggctaagaatgtcttacctgagccagtaggcccgattaaagcgatattactcttttgaagttcagtatcacctttttcggcaactgtcatttggttaacacgtttgtaatggttataaacggcaactgagagcgcctttttagcttctgtttgaccaatgacataatcatttaaaattgcaagaatttcgcgtggttttggtacttctaataagtcattaacagcttcatctttaaattcttcatcgataatttctttacagagatcgatacattcattacagatataaacaccagggccggccacaatcttctttacttgatcttgtgatttaccacaaaacgaacaagtaacagggccattcgttgtttctgtatcatctaacatttatttagcgtctttaacttcaacagctgaatcagcaatcacttcgatagctttcttaacaccgatatcatgttttaacatgtcatctgataagacgctgcgaacagctgattcttccatgttgtattgttctgctaaactcttaagttctgcagcaacttcttcgtcagttgcttcgatcttttcagcttcaacaacagcttctaagacaaggcttgtcttaacgcgtttgtcagcatcaccggcgaattgtttcttcaaatcatcttctgttgtaccagtgatttgatagtacatttctgggttgataccttgttgttgcatgttacctaagtattgttgtaattgactgttgatttcttcgtcaatcattgcttgaggtaattcaggaattgttgcattttctgttgctttagcaacggctgtatcttggatagcagcgtcagcagcatcattcttttgttgttttaattcttcacgaattttttcttttaattcgtctaatgaatcaacgtcttcgtcgatatccttagcaaattcgtcgtcaagttctggtaattccttacccttaacttcgtgaatcttaaccttaaagattgcttctttaccagctaattcttctgcttggtaatctttagggaatgttactgtaacgtcaacatcttcttcagctttgtgaccaactaattgatcttcaaaaccaggaatgaatgagtttgaacctaattctaatgagtagttatctgcttggccaccatcaaaaggtacaccatcaacagaaccagcataatcaataacgactgtgtcgccattttctgctgctgcatcttctttaagtactaattcagcttgacgttcgcgacgtgtttcaagttcttgttctacgtctttaattgtaatacgacggctttgttttggtacttctaagcctttgtaatcgcctaatttaacttctggtttaacagtgacctgagcagtaaggacccaagcttcacctttttccattttttcaacattaatttgtggttgatcaactggatcaatccctgcttctgcaacagctgcttcatatgcttctggtaatacagcatttaaggcatcttcgtaaagtgcttcttcaccgtacatcttgttaaagatttggcgaggcatctttcctttacggaaaccaggtgtgttgatgtttttacgtacacgtttgaacgctacgtctaaaccttcactaattttatctaaatcaatttcaaaggtaagttcaccatcattggcgccctttttttcccattttgctgacatttagtcaataatttcacttacgacaccggcaccaacagtacggccaccttcacgaacagtaaacttaagacccttttcaatagcaactggtgagattaattcaacagtaaatgttacgttatcaccaggcataaccatttctacaccttctggtaattcgataacacctgtaacatcagttgtatggaagaagaattgtggacgatagtttgagaagaatggtgtatgacgaccaccttcatccttgctcaagatataaacttcacccttgaagtttttgtgagtttggattgaaccaggtttagctaaaacttggccacgttcgatgctttcgcgatcgataccacgtaataaagcaccaatgttatcgccagcttgaccttgatccaatgtcttacggaacatttccaaaccagtaacagttgtcttagcaatttcttccttaagaccaacgatttcaacttcgtcaccgacagtaacttggccacgatcgatacgacctgaagcaacagtaccacgaccagtgatcgtaaatacgtcttcaacaggcatcaagaatggtttgtctgtgtcacgttctggagttggaacatattcgtcaacagtagccattaattcttcaacagctttaacgtcgtcagggttgccgttcaatgcaccaagtgctgaaccgcggataactggaatatcgtcaccagggaaatcgtattctgataataattcacgaacttccatttcaaccaagtccgttaattcatcatcatcaactaaatctgttttgttcaagaagacgatgatgtaatcaacaccgacttggtgagcaagcaagatatgttcacgagtttgtggcataggaccatcagttgcagcaacaactaagatggcaccgtccatttgagcagcaccagtgatcatgtttttaacgtaatcagcatgtcctggagcgtcaatatgtgcataatgacggttttctgtttcgtattcaacgtgggctgtattgatagtgataccacgttctctttcttctggagcagcatcgatgtttgcatagtcttgagcttcagccaagcctttgtctgccaacatctttgtgattgctgctgttaaagttgttttaccatgatcaacatgtccgatagtaccgatgttaacatggggttttgttctttcgtaatgtgctttttctgccatctaaaagactagttcttctgttaattcttgcaatttttttagccactgaatcgtcttttctgaaattggaactgttggttcaaaaataaagacccctaactgttgaatcagcgcctggccccattcttcaggattatcaatcaccgtttcctcaaatggataaagataggcaaacgtcatttgacactctgctaaggccgcttctaaaataattggatcttgttgccccaagatattttgaattgttttttgaattaattttaaaacaggccgattagtcatcaattctaactcagaaggtgtcacttgttggacctgatcaaaccaattaatcgtcactgattctgaatatcgcaaacgaacgagcgtttctaaaatcgttgttttcacaaatggatggcaatacgggttcaccaaaattggtgacaccccctgtaaataatcagctagtggtaataattctgctgcatccagtcggcgttgttggtcttgaaaatcacccgttgtaatattgtagagttgttcttggcgtttcttgattgcctgctgctcagtcgcttggtaggctttttcagccgtttttaatagcgcttgtcccttttgcttagttcgctgttcaaaggcgtcagtcgcctccacagcagaccacagctcattggccgcgataaagtgctgatttttaatgagtagcccattatacagcaaccttaaatcggtctcattggtatagaagtcctttttttcaaaggccaattgcagcgcgcgctgattgtcaccagcagccactaatacactgaccaataaaaggtttaatgccgttgtttgttgcaagtcataagcagcctccaaatgggctattgcttctggccattggcgctggttgagcgctactttgcccagacggaccaaattttcaaattgattcggcaaggccgtcaattctcccatttaatcttgttttttctcaactgctggtttggtgtctttcttttgacgacggtgattttggttaatttccataatcacaggtaaaataactggacgccgttttgtttgttcgtataaataatgacttaagttttcgcgaacgtcttgtttcaagtgactccagtcaaactctttgttatcaaggttattttgaacagcttgcttgatgatttctgaactttctgccatgaggtccttacttgtcttaacgtagacaaaacctcttgccgttactttcggttcagcaataatcttcttattcttccggtcaattgtcacgaccgcgataaaaatcccgtcttcagacaataatttacgatcgcgcaagacgatgttgccgatatcaccaatcccactgccatcaatcatgacatcagtcgcatcaacttgaccaccaacatgcatcttatcgttgtcgtaagcgacaatatcacccttacccacgatgaagatgttcttataatccattcctgtttcatgcgcaatatccgcatgagcagccatttggcggtattcgccttgaacaggcattaagaattgtgggtgtaataagttcaacattaactgcaagtcatttttattagcgtgacctgaagcatgtagatcatcgccgacagctttgacttcgccgcctgcgcgataaatcatatccttagttttcgctaaaatagtttccattgcatgtgaaggtgacgttgttaaataaacaagatcaccttgttcaatatggattaaacggtgatggcttgttgccatcttttggagggctttgattggttcacccatgcgacctgtttcaaggatcactgtttcttcaggtgccaatgtacttaacgctttaggttgtactaagatatcttcatccggcaaggttaacatttctaaccgcattgctgtccgcacaattttttccaaatcacggcctgttaaaacgaccttccggtttgttttataagcggcatcgataacttgttgaatacggaggatatttgaggccactgaagccacgataatccgcccgttttgatatttaaatgtttctaaaattgattcggcaatatcgcgttcattagccgtttcaaaaggtgattccgcattagcagagtcactcaatagggctaagacgccttgttgaccgatttcagttaaacgggcataatccgtttgatacattggtaatgctgattgatcaaacttgaagtccccggtgtaaacaatttggccttcatctgttttcacaacaatccctaacgaacctggaatggtatgcgttgttttgaagaatgaaactgtcgcttgttcaaaatcaattgctgtattggcattaatcacgtggaaattattgaaatgccgtaatttaggttcgctgctgaccgtaatcttagcgagcgcaattgttaattcagaaccaaagacaggcacatcatggcctttcaagaagtatggcaaggcgccaattgcatcagcgtgaccgtgcgttaggaaaatcccagcgacacgttctgcattttcttccaaataagtcatatctgggattacaatatcaatccctaataattcagtttctgggtattttaacccacaatctaagatataaatttcgtcgttaacttccacaacgtttaaattcttaccgttctcgcgtacaccaccaagtggcataatcttaatattactcatttaacgacgtaagccaaggctcttgattaattcacggtaacgttggatatcgttgtcacgtaagtaacgtaaaaggttacgacggtgaccgattttcttcatttgaccaacatatgaatggtgatctttcttatgaacagataaatgttcgtttaatgagttgatttctgcagttaagacagcgatttgtacttctgctgaacctgtatcgccttcgtgacgtgcatattcattgatgatttcgttttttcttgcttgtgaaatagccatatgccacaaattaaatctgctatgaaacgtgtgaaaacaattgaaaaagcaaacaacagaaacgcttctcaattaagcacaatgcgttcagcaatcaaaaagttcaaagctgctcaagctgctggtaacgaagaagctgcagacctattaaaagctgctacacgcgctattgatatggcctcaacaaaaggcttaatccatgctaacaaagctggccgtgacaagtcacgtttaaacaaaatgatggctaagtaactatgccacttttttagcggcaaattggagcatgaacagttcaaataacaattcaggttgtccctgtccggttttaattttaacttcgatttcttctaaacctaagtaagcttgcgctaaagtttgctttgaaaaatgtttaatctgttgcatcgccaatttaattcggtacggatgaatttttaaaacactggctaaattgccctgactataccctttttcaaatagaattttaacttgcaatagtaagcgaaattgaccgatcagaatcgcgttaatcttgagtggttcttctttttggagtagtaattcgtgatacatcgtcaaaacggggcccacttttttctgcaaaacaagcggtactaatgaaaagacgttatcttcaatactgctgctgactaattcagcgaccgcccctgtcgtaatttgtttagtttgttgtgcgtacagcattaatttcggtaattctgccatgatttggctatagtcactattggttttactaatcaataaggctaacgcttcactatcaatctgcatcccctgttgtttcaactcagcggttaccaattgttgcacttggcgctcattcactttttcaacagaaactaatgaagcaaccttttttaattgcttcacgatttttttacgttcatctaacttagggtacggcgcaaatagcaccacactagttgttggttgtggcttttcaagataggcttggaaacgaactaaatcctgatcgagcttgtttttaaccttttcacccgttaaaaaatagggattttgcataaagacaattcgccgctcaccaaaaaaaggtgccgattcggcatcatccaaagcattcgccacatcggtcgttgctaaatcgtagctggcaaaattcattgttcgttcttcttctggtagatagtgtttaaagagttgacgcgctttttcaatcaacgctgactcttgccctaaaaccaggtaaatcgttgctaattgattttgttgaagctctttttgtaattgttcaattgtcattcatttttcactatcctttattgttgtttgcagtttttcgctttgaccggggccatacgaccaggtcaacatcccctgctgggccgttagccaataaggcactttggccgcttgcaaagtcgtcaaagtttcctggtgcggatgaccataacgattctctctgccggctgagattaatgccccttttaagtgtaattttttaatcacggtggggtcactagccgtttcactaccgtgatggccaacttttaaataatcgacggttaactgtggataccgctcgataatcgctcgttcgccttcttgctctaaatcccctgtaaacagccagctagccccaccaatttgtgcctgtaagactaacgaatcactattttcgccttttcccggcttagtcggcgctaagacgttaaacttttgcggccccactttaaaagcggtcccggctaaatagggttcaatttgaaccgttgctaaaaatggtcgaatttgtctttgaaattgccgattttgcggtaacccggcagcacaaatgattcgatcaacacgaatttgtttcaaaatctgattcaaatcaccaatatgatcggcatcctgatgagaaagtgccaccgcatcaatgtgatctactccttggctatagagataattaaccgttactttttccgctcgtgaaacctgcgcccgccgttgccaagctgcttgcggtagcgctaggcggccaccagtatcgattaaaagctgatgccggttaaacggcgtttgaatcaacaaactatcaccctgaccaatatcaaacatgactacctggccagtcggattaaaatgaatcgccaaaaaactagccaaatacaaacttgccaatgtgcgtttcagccgtttacgccactgattgctaatggcctggccatcgattaacaagaggctgaccgtcacaatcaatagtaatggtaacaaggggattttaccaaacgtaatcatcgcatgggggatttgagcgactaatcctaagcctttgtaaatcaactgtaacagccactcacatccgttaactactagattgctaacaggtaacatcacactcgctacaatcaccaaacctagcacaactggtagatagataggcgttactaaggcattcatcattatcgtcagcacgtgccagcgataattaaagcgtaagcaaaccggcaaactcaataaacttagccagtaagcaactttaaacgtgctaccctcaccaatataaatgagcgcaaaggccatcaaataacttaaaatcccgcccatactatgtagcaaataaggctgccagaataaattgaccagtaatactaaactccaactatctaatcttgattgccgaatgcccaactgttcgcaaagtaaccggcataaaataagcgcaatcgcgcgactaatgcttgtcgtaccaccaaccagtaaggcatataccggcaatagcccaaataacatacagtttaaccactcacgcggtatacggcaataagtcgcacaccaccgaatgacttgcactaaataaaacacgtgcaaccctgatagacttaatagatgaataatccctaagcggcccaaaacaacctggtaatggtcaacttgcgcttcccgcaaacctaatagtaacgtctgcgcatgaaaccgtagtgctgttggtaacttacgtaaatacagcgcacacgtttggcgccaataatgtagccaatccaaaccgctactaggacgtctcagcgcaaaagttgtttctttggctaacgtcagttggtaaaagcagcgcttctgttgcgctaaaaaacgggcataatcaaactcattttgattggtagctccttgtatacgttcaaaatcttttgcgccatagaacaaaacggggtgtcgtacttgttgccactgcctcttctcggcgaacgtttggcagcgataataagccttaatagtctgaccatcttgttggccgattgccgttaattgaacactgtcgcccgcgacttgaatcgcatcgggttgcactttaaaatactgtgctaccggttgttgtggttgtgtcatactatgatagcttatccaaaaacggcccccataaacaaggcataagccgatcgtcataatcgttatctgagtttgtctgagacttattaatttgacaaaagccaataataataagctccaggttaaccaagattggcccccaagcattaagctatttaaactgattaaacaaataactggataaatccagttgtttttcattcattcagttgcttgttcgttctccaagaaattaacgagtgtgtgcgcatcatcaactgataaattaacttgatcaagttcaatccctgatttttcaattaattttagcgcgtaaggatcattatgataatctttttggtaatgaatcttactgatacccgcttgaataattagttttgtacattgtaaacaaggaaaatgcgttacataaatttcggcgccttcagtttgaacgccaaatttggcacattgcgttagagcattcatctcagcgtgaatggttctgagacaatgaccatcccgcattaaacagccaacgtcaatacaatgatcttcgtgagccaccgagccgttataacccccggcaataatccgccgattacgaatgacgagcgcccccacaaatagacgtggacaggtactgcgcatcgataataaaaccgactgtaacataaaatactgattccaaggcattctcttattggccatctaattcacacaaatttgtgattgcaattgttcaaacgtcttcggaccaatcccgccgactttttgtagatcttcaatctgtttaaattttccttgttcatcacgataagcaattatttgttcagctttcttggggccaatgccattgagggtctgaagctgcgtactatcagcctgattcaaatcgattttagcagtgtcactcgcgctcgatgcattcgcacttgtcccagttgatgcttgttctggcgtacgctcactggtcgttgcaatttgttgtggcgcttgaatgagttcttgatcagtaaccacctctccttttttcggaatataaataatcagttgatcggttaatttttgggctaaattaagccgcttggtatcagccgcatcagtcggaccacctgcatttttgagcacctcaaataagcgcgtttcagagactgtgatcggataaattcccggataagccacttaatgatttttcaaataagttaacgcatcatctaaggttttgaccggtacgatcttcatcttagtatgaatttttttagcggcatttttagcgattgtataattattttgataatcaggatcaacctttaaaattgcctttgttacaggatcattaggtgcaaaaaagacggttgcgccttcttgactagcgaccagtacctttttatcaatcccaccaatagcacctacagtgccatcagcagccattgtgccggtccccgcaattttacgacccttttggagattttgcttcgttaattgattataaacttgcaacgtaaacatcaagcctgcagatgggcccccaatatcaccggcatcaattttaaccggaatatcagtctcaatcttagagtgatcggttaacgtaatcccaagacctggatgatgcgtgcctggtaacttaatcaaacgatgcgttgccgtttgatgtttttgaccatgatcgtaactaaccgtgaccttttgaccaactttcaaaccttggacatactttacaaaagcattggcatttttaaattgatgatgatcaatcgcggtaatcgtatcaccgactgctaaatcatctttaaaagtggagttgtctaacatcgacatcacataaacgcccagatacttcgtatggtaggccttatcagcttttttataggcggcttcaacggcagcgttaattgaactatccatatagtacttttgaatctgttcgtaagcttcggtatcttcattgcccatcaattcgtcacgactttcaatttccgtaaaaggttgcgtcttggacaataataattgcaatggtgttactgggcctctgacaccaactgttgtcagcataaaatggcctttttgatgatcatgtttaccgtcgaccttaacatattggctggtattttctgcggtcccggcaccttcaatataatagccagtgggcattaaacaaacaactgcaacaatgattaaaaccacaattacaattaatcgttttgtcagtttcttatttttgggcatctaatctcttccgtgttttaatttttcttgaagtgcaactgcgactgctggtggcactaattgatcaacttgaccaccaaaagcagcgatttccttaaccatactagatgaaataaacgaaaattcttgttttgctaataacaacacggtttctaattgtgcatcttgcgtttgattgagcgctgcaatatcccgttcgtattcgaaatcattagcattccgaatgccccgaatgaggtagcgggccccaacttcttgcgcgaaattagcggtcaacgttttaggttgcgcaacaacgctcacattgtccaaatcagcaatgacggtttcaatcaatgcgactttcgtgggaccatcaaataatggcttcttcgcggcattagtcatgaccgcaataatcacccgatcaaataaccgacttgcccgttcaactgtatctagatgtcctttggtaaaaggatcaaaactccctggaaataatgcgattctttcagtcatttaaccgataaattcgaaaattgccacttcagtaatcccgtagttctgttggcgtttcaatgtataatgtgggatttcttctggatacgttaaactcgtgtccgtttcacaaagaataatagcccctggttttaagaggtccatcttcacaaattgttgtaactctaataacatttgttgttgcttatagggtggatctaacaaaattaagtcaaattgttctttggcatccgctaattttaacaatgctttttcagctggcatcttccaaattgtaaaacattctggcattttcgtgacagctacgttatcttgaatcgtttgaatcgccgcgtattggcgatcaattaagtaggcatgatccataccgcgcgaaacagcctcaatcgcgagaccaccactaccggcatataaatcaagcgcctggccaccatcaaaaaattggcctaacatactgaacatggcttctttcactttatccgttgtaggtctagtcttcattccggggaccgcttttaagcggcggccaccaaattctcctgcaataatccgcatttactcctttaatgccgctttagtagcggtctcttgattcgctaattcggctaatgcgccaaattccatgtcgagcattggccgctgtgaacgcgtcacccgcttaacataatgtaatttctttaatcgttcgataacagccggtgcttgggccgcatcaacgtataaataaacatatttcatccgtttagacgtgtaatacacaagtccgtaacgtcgcaattgtttgacttgccgtaatgaatacagccagacaacaatgccttgtcgttgcgtgatttctaatgccatttattcaccaatcacaaccagtgtgtgaccctctgtacagataatttgaatccgtcgatggacctggttatggattgcttggtaaaatgctggattggtctgccgttcaaaaatgagctgctgcacactgactggctgctcaaaataaaagaactgttggttagtcagttgataatcttctaaagccttggtggtaaaatccgcttcagttaatttttgcggtaaagccatttggcgttgttgcttggcacgcttcaatcgctgctccccagcatcagttagcaacgtcttaggcgcacctttcagcgtcgccaaaaataattgatccgcttcaagtaatacgtcgctacgcaactcaggtaacttggcattgagtcgcaatgtctgacaatactgtagcaatgccaattgccgttcatcatcgatttgctgggactgtcccgttaccacttctggtactgggactggcgtcattgaggtcaccggatataaattcgattgtaacaagcgattagcattcaaataaaccgccgttgccaattcacctttttgcattaccaaaatcgcataggttttattcttaaatgcgatcagtggtcgttgccgctgttgcgtttcgttcaactcaatttgaaacttttgctcatgtaaacttaattcataattagccggaatcgttgtttcctgtgtgattgcttttagcgattggccaaatttaaacggcttgatcgcattatcctgaccaatcaccactaattgttgtgttgtccctgtctgatcatcaattgtcgcttcaatataatgccgactattcaattgaaataaccaacgactctgcaggccatcttctgccgattgcttaacaggttgcccatattgcgctatcaattttgcggcaggttgattgataaacttcgccggcccttgcgtttttaataatggattttgcggatgcgttaatttcatatgacgtttagtttggccctgcgttgaatccacagttggttgaacatgatgcataatgggccacgcatacaacaatactaaccacgcgcctaacgctaccacaaagcgcatcaaatttttcattcacgattgcttcattttgagtgcctttttttcctgagcactgacgttcaagaccaaaccaagacccgttgctaacaccaacatacttgacccaccataactaatgaagggtaaggtcaccccggtaattggcagcaagcctaatagaccaccgatattaaataagctttgaacaaaaataatcgtgccaatcccataacaaatcaaggcattataggtttggcgagctctgattccgattgtaaaaattctaaaaattagtaaaaagagtaatcctaaaatgaaaagggcccccacgacaccgagttcttcagtcgtaatcgataaaatgaaatcagtgtaaggttcaggtaaatagcctcgtttttgaatactattaccgaggcccataccaaaccaaccaccattattgatcgcataatacgagttaaccagttggctcccacccatattttcgagtttaaacggttctagaaaggctaaaattcggttaaaccgataattgacaccggttgttaaattcaaacgactcaatccagcaatggccgcaatgatcaccgctaaggttgcgctgatgattgaaattccccaccagaaggaaatcccactggcaaataataataccaatagaataatccctagaatagccgccccaccagtatcgggttgtaccaatacaaaggcgataatgacggccaccaaaatgacgggtgcggaaaatagccgcacattatcacgccaatgctctgacaaattcttttcacgtttggataacatattagccaagtataaaacaatcaataacttagcaaattccgctggttgaatactaaaaggtcccaaattaatccaagcggtcgccccattaatagcggcgtccggtctaattcggcttaataccaacaagtaaaagagcgctaataaaataaccgccgtgacaccaatcaaaaacttaggtttccttaatagatttaacttcaaaaagaaggagaataataataagacgaatcccagcccgatataaattaattgcttagtaaaataagcatctggcttagcaccgtgaatcgacatcaaatccgaactcgccgaatagaccatcaaggcccctatcgcacataaaataacgtacgggattaataaccaataatctaaatactgcgctttatctcgaagcttatgccacacctaatttctatgaacttcattctgagcttgcgtttgataaatctctaaataaagttgattaatacgcgtttcaagttcgttcactaatttcgatccttcttgatcactaattaaacgaattcttttagcaaaatcaacctcttttgtaaaaccaaacagttgtgtatcaataatttcttcaatgatgggacattgacttaaacaaagcgcatcaaattgcttcgtcaataacgcttcaattttagctgcgtctgatttcaaagtcacatacccgattgtttcttgtttaatcatcatttatccgcgtttacgcttcttgtcagctttagtacgcatacttgtgtcaagaatcttcttacgtaaacgaacagaagtaggtgttacttcacagtattcgtcatcatttaagaattcaattgattcttcaagtgacatttctttaggtgtcttgatagcagctgagtgatctttaccagaagcacgagtattcgttaagtttttacccttagtaacgtttacggcgatatctgtatcacggctattttgaccaacgatcataccttcataaacatcaacgccagcgccgatgaataattggccacgatcttcaactgattgtaaactataagttgttgatgaaccggcattgattgaaactaatgcaccgttacgacggcctggttcccagtttttgataactggcatgtatttttcgaaggtgtggttcataataccgtatccaccagtcatcgttaagaattctgttgaataaccgattaaaccacgtgaaggtgctaagaaagtcatacgtgtttggttattagcatcactttccatgttttgcatttcacccttacgttgggccattgaatcgattactgaacctgtgtattgatcaggtgtatcgatttgaaccatttcaaaaggttcgcaagttacgccatcaacgtcgcggtagataacttctggacgtgataattgtaattcgaagccttcccgacgcatttcttcaaccaagattgaaagatgcaattcaccacgacctgaaacaatccaagcgccggctttgtctgtatcttcaacacgaagtgaaacgtcagtgtgtaattggtgacgtaaacgttcttcaatcttacgaccagtaacgaaatcaccttcacggccaacaaatggtgaatcattggcagcaaatgtcatttgtaaagttggttcgtcgatacgaagaattggtaatgcttcttgatggtcaactggtgtgacagtttccccaacgtagatatcttccatacctgaaacagcgattaaatcgccggctttagcttcttggatttcaacacggtctaaaccgatgaaaccaaagatcttagtaacccggaagttcttagcagaaccgtcaagtttaagaacagaaacttgatcaccgatcttgattgtcccacgagaaacgcggccaataccgatacgaccaacatagtcgttataatctaacatagccacttggaattgaagtggttcgtcactattatcaactggtgctgggattgtatctaagattgtgtcaaagataggaaccattgtgtgagcttgtgtgtctaagtctgattcaagacttgatgtcccgttgatagcacttgcgtacacaactgggaattcaagttgatcttcgtcagcaccaagttcgatgaataattcaagcacttcatcaaccacttcttcaggacgtgagcctgggcggtcaattttgttgataacaacgattggtgttaaatgttggtctaaagcttttttcaaaacaaaacgtgtttgtggcattgtaccttcaaaagcatcaacgactaataatacaccgtcaaccatcttcatgatacgttcaacttcaccaccgaaatcggcatgtcctggtgtatccaagatgttgatttgtttgccattatatttaacagcagtattctttgaaagaattgtgatcccacgttctttttcgatatcatttgtatccattgcacggtcagaaatttctgcatggccatccaatgtatctgattgttttaacatttcgttaactaaggttgttttaccatgatcaacgtgggcgataattgcgatattgcgaatgtcttctctttttttcaattattcggccgtttttgaatgggccataatggcgataatttcttgcatcgcttgctttggtgcaataatcatcccttctttggcaaccattgaaattggttgaccatcgaaatttaaaatctgaaaaccaagtgtctcggctaaaacgcgtcccgcagcaatatcccatggtgctaactttgaaatataagcttgcgcattccctcttaacaattgcgcaaaggtaatgccggcactgccatagatacgcacacctgagctttgaacgaagacctgttgtaattgtcgttcattcgtcaccaacatgcgtgtattaacgcagattaagccttccgatagcggttggtccgctgcctgttctaaggcttgttcattgcggaaaattcctaattgcggaccaccccagaaaagttgatcagccatcacatcgtaaataatcccgaataaggcttgtccatcttcgtagaccccgatcataatcgcaaaattttcctgttgcttaacaaaattcattgtgccatcaattgggtcgacgaaaaaagttagaccattatgccaatcaccagcaccgacattggccccttcttctccgactaattgcgccattgggtattccactttgatttgttctgcgaaaaaggcttggttagcgcagtcgacgttggtcactaaatcattacgacttgatttagtcataatttctaaaggttgtgtcatctttttgcgtgtttcagcggctgcttcaagtacccacttttgtaatgaacgacttaattgatatagcgcctcttgttccattcaattattagtcgtcatcttaatttgtgcccggccactcttttgagcagtttgcatacaacgatagattgaataaccagaagcttccgtaaaagccttatcaagttgtttttcaatcatcttgcttcgaacgacttgtttaaaatcacggtaggccacgtttaaatcttcaactttagcgccaaattcataagcttgttcaacaagattatataaatgcatgacttgaaccacttcttctggtgtccaatctgattctaaaggatagctatagttagtttgcatttagatgtgaattggtaagcctagtgctaattcagcgtcatccataattgcttcactcaatgttggatgtgggtgaattgttaaggctaaatcttccgcattcatccctgattcaattgctaaggttaattctgagatcaagtcgctagcaccaacgcctgctacttgtgcaccaagcaacgtattatcgtcaacattcgttactaagcgtacaaaaccttcagtatccgctaatgataaagcacgaccgttagcagcaaatgggaacttaaagcctttggcgttatagcctttttcttttgcttcagcaaccgttaaaccagtggttgccaattctggatcggtataacaaactgctggcattgctttgtagtccacaatcacttttttaccagcgattgcttctgcagcaattttagcttcatagctcgctttatgagccaacgcagcaccggcaacaatatcaccaatagcgtagatgcctttgatattggtttgaccttgttgatcaacttcgattaaaccacgatcagccatcttgataccagcttgttccaagcccatatcatcagtattaggacgacgaccaacagttaccatgacataatcggcaaccaattgttcttccttgccgccaacttcgtatttaacagtcacgttttgatctgtttcgattgattctttagccatagcaccggtaatcacatcgacacccttagtcttgaagttcttcgttacaagttgcaccatgtctttttcgaagtttggcaaaattgaatccgttccttcaagaatggtgacgtgggcgcccaagttagcgtaagcacctgctaattcagaaccgatgtaacccccgccaatcacaactaattccttaggcacttctgttaagtttaaaccaccagttgaatcaatcacgcgtttgttgaacttgaagcccttaatttcaattgggcgactaccagttgcgatgattaagttcttgaaactataagtttgtgcactttcttctttaatgacccgtaagctatgttcatcaactaaaaaggcagaaccgtctaagacatcaattttgtgttttttgaacaacattgaaatgccgcccgttaatttttcgacaacttggtgttgtttccagtcttgcgtctttgcaaaattaagcgttgcacccgttgttgaaactccgaaaacttcggaattcttagcttcttgcaaacgatgacctgcagagattaacgctttagaagggatacagccgacgttcaaacaaatcccaccgatattttcacgttcaataaccgttactttttgacccatttcagctgctcgaatggcagcaacgtagcccccaggtccagaaccaataacgacagtttctaattcaattgcaaaatcacctacaaccattcatccttccatcaatagtagctctggatcagctaataattcttttaattcgttcattgcacgttgcgcagtcccaccatcaattaaacggtgatcaaatgataatgataatttcaagactttaccaactgcaagttcgccatcttcgttaacaattggttctgtgccgatacggccaacccctaggatagccacttcagggtagttaacaactggtgtaaaccaaccaccaccgattgacccgatgttactaatcgtcattgaaccgccactcatttcagcaggttttaacttattatctaaagctttttgagtgttttcgccaatttccttagcgatggcaaagatactcttgctgtcggcatctttaatgtttggtacataaaggccgtgatcagtatcggttgcgatgccgacattaatgtagtgtttataaacaatttcgcttgttgtgtcgtcaattgaggcgttcaacgttgggaaatcacgtaaaacagttactaaagccttaacaatgtatggtaagaaggttaacttaatatctttcttagcagcaacatccttaaatttcttacgatgggtcattaatttagaaacttcaacctcatcaaataatgttacgtgtggtgcagtatgtttgcttgtcaccattgctttagcaattgcttttcgtgttggtgacatcttttcacgtgtttcaagttctggtgttgcggattcataaggtttaacggctactgctggttcaggtgtcgctgttgttgcaggggcactcttagtatcagttgttgtcgttgaagcaattggtgcagcgccattttgcatgaagttttggatatccgcttttgttgtgcgcccgtgtttaccagttgctggcacttggctaatatccacgttattttcacgtgcaaattgacgaacagatggcattgccaatactttccgatttggatcactaatggcaacaacacttgcgtcactgctattattagttgctactggtgtttctgttgccttaggtgctggcgtttctgctacgggtgctgaagctgttgcagtattgtggcctggcgcatcaatttcaacgagcacttgaccgactgttgcgacttcaccttcgcccactaagattttaacaatcttaccgctaacaggtgatggaatttcttcgacggatttatcattttgaacttctaataaggtatcgtcttctgcaattgaatcgccttctgcaactgcccatttttggatttcaccttccgcaattccttcaccaatatctggtaatttaaattgataaacgccttcactagctgttggcgctgaggttgcgggttcttctgtcgctggggtagttgttgttgatgttggtgcatcgttaccttcaacccctggcgcatcgatttcaacgagcacttgaccgactgttgcgacttcgccttcgcccactaaaatcttaaggatcttaccactcactggtgatgggatttcttcaactgatttatcattttggacttctagtaatgtatcatcttcagcaattgtatcgccttctgcgactgcccatttttggatttcgccttctgcgataccttcgccgatatctggtaatttaaattgatatgccatctaaaagttaataacttccttaactttattttcaatatcagttgcgtttggtaaccatgttgattcggcttggccaaatgggaatggtgtatctggtgctgaaacgcgcccaattggtgcttctagtgaaaggacagcgcgttctgaaatttcagaagccacttgtgccccaacgcccgcttgtttttgcgcttcttgcacaatcacaacgtgacctgttttttcgactgatgcaataattgttttaatatctaatggggcaattgtccgtaagtcgataatttcaactgagatattgtctttagccaagttttcagcagctttcttagcttcgcgaaccattgcgccataagtgatgattgaaacgtccgaaccttccaatgttactgcggctttatcgagcggcactgtgtatgattcatctggcacttcctcacggaatgagcgataaagtttcatatgttccaaatataaaacaggatcatttgaacgaatcgcagaaatcaataaacctttggcatcgtatggattacttgggacaactactcgaatcccaggaatttgggtaatcataccttcaaaattatctgaatgcatttcaggggtatgcacaccaccaccaaatggtgcccgaattgtaatcggcatattgcgtgtgccacccatccggtaacgtgtccgtgacatttgaccggcgattgaatctagcgtttcaaaaataaaaccgaagaattgaatttcaggaacaggtctaaatccttctagcgctaacccgattgataaaccaccaatcccagattcagctaaaggtgtatcgaaaacgcggtcttcaccatgtttaacttgtaagccttcagtcgcacggaaaacaccaccgtttttaccgacatcttccccgaaaattaagacattttcatcacttgctaattctaaatccagcgcatttgtaattgcttgaatcattgttttttgtgccatttaattcgactcctttgcactgtattctgcgatttgttcttgaatgttttgtggttgttcttcaaacgttacttttaagaagtcagttaccttttgtttaggaatagcatctgcttcgttgattgcttctttaatagatgctttaacttgatcaatcaattcattttcttgttcttctgaccagagacccttatccgttaagaaacgacgcattctaactaatggatcacgttttaaccaaatatcatctgtttcttttgtccggtaacgtgtagggtcatccccggaaagtgtatgtggcccataacggtaagttaaggtttcaattaaaacaggcccattaccagcggttgtgaaatctctagcttctttcattacttcataaacagctagtggatccatcccatcaacttggatggcaggaatcccagcagcaacacccttttgggctaatgttactgcggctgtttgtttttcacgaggaactgaaatggcaaaaccgttattttgaacaacgaagattgcaggggctttaaaagcaccagcaaagttaatgccttcatagaaatcaccctgtgaagtaccgccatcacccgtataaacataaacggcattcttggattgacgtttcttcatcccgacagcgacacccattgcttgaatgtattgtgccccgataataatttgtggtggcattgctttgagtgattctggatacttgttaccttcaatatgaccacgtgaccataagaaagcttgtgatagaggtaagccatgttgcaccaattgtggtacatcacgataaccagggaataagaaatcatccttgttcatcgcaaaattgcttgctaattgactcgcttcttgtccggcagttggtgcgtaaaaacctaaacggccttgacgatttaaggcagttgcacgttgatctagcacacgtgaccaaaccatctgtttcatcaattcaacaagttgttcatcacttagatctggcatgatatcaggatttacaacttggccagtttcatctagaatctgaactgttttaaaatcttggctttcatcgccgagtagtttatcaaaattaactgcagctttattattggccattcatgccaagaccggttgagggatctcagcgttcccagcatgtactaggaagcgttgaacatccgtccaaactggctcaactcttagatgagtcatgaggcgatgaagattaactaataggcgcatccgtaattgaccgatacttacgaaaacaagtaggttcttgaattgccctgattttgtaacgcgcatcatcataacggcagtacaaactgctaagccgattgtcacaccagcaaaagcaaattcattaactgcaaggaccgcaaggaatgacacaagtgctgccactgccataaggaaagcattccctaggcgaaccttaacgacatcatccttaggtgatagtgtttcgttcaacacgacacctctcgtacctgttttaacaactgtaccggctttgatgaccgccatttctttatcgattgttgctacggcaactggtgttttttctgcagcatctaatactaaaatatcgcctgctacaatttgatcaacaccaatttcgcgtaggaaaccgtcgcgtacaacacttgccatccgatttgaatcggcaactagtgatgcccgctttgcagcttcaatcgttgttaacccgcttggacgagttgccaacaaacgcattaacatcccgctgcttgtgattgcgtttaacgttgtttcttgctttaaattcttgtgcatgtgatattaatgaaagatattatccgcgagggtaatcctacacttagagaaattgcacaacctgtttcattcccactatctgacgaagatcggcaacttgccgctgacatgatgacattcttggaaaatagccaagatccagaaattgctgcgaaatatcaattacgcgctggtgttggcttagccgcacctcaagtagatgtttcaaaacagatgtcagctgttttagtccctggccctgaaggcgaagcaccaatcttaaaagacgtgattattaatcctaagattattagccactctgttcaagacgctgctttagctgaaggcgaaggttgcctatcagtcgatcgcgaagtccccggttatgtgccccggcacgacagaattacattacgttatcaagacgttgaaggtgttagtcataagattcgtcttaaaaactaccccgcaattgtttgccaacacgaaatcgatcatttaaacggtattcttttctttgaccacatcaacaaagaaaatccatttgccgcaccagacgatatgattattcttgaataattatgcatttaattttgtttctgcaaattgactgttataaagcttagcgtaaacaccattagcagctaataagtcgtcatgtgttcccttttcaacaatttgaccgtgatccattactaaaattaagttagcatcccgaattgttgataagcgatgggcaatcacaaaactggttcgaccctgcatcactttttccatcgccttttgcaataagctttctaagcgcgtatcgaccgaactggttgcttcatctaaaatcaaaattttagggttagcaatgaccgcccgggcaattgttaggagttgcttttgccctaacgacacgttatccgcttcttcatcaattgccatctgataaccatttggcaacgtatggatgaagtgatcaacattggccgttttggcagcatccacgacttcatattcggtagcatctagcttcccaaagcgaatattttccgtaatcgttgtgtgatacaaccaagcatcctgaagaaccatcccaaagagtgagcgaactgtttgtttactcaactggcgtgtatcgacgccatcaattaggatttgaccagaactaacatcgtaaaaacgcatcaataaattaatcatggtcgtcttcccagcaccggttggcccaacaatcgcaattttatcacccggattggcggtgaaacttagatcccgaatcaatggtttggctggatcatagctaaagctgacatctttaaattcaacttttccctgaacgtcagccggtaattcagctgtttcttgatcagtgggttcaataggttcatccaagatttcaaaaacccgttgtgtcgcagcggcagccgcttgcatgacaccagataactgcgtaatttgcgaaattggttgattaatctgccaaatatattgaataaaggcctgtaaattaccaaccgtaatgaccccgtgcaagacatagtaaccacccaaggttgccatcccagcataggttagattagtggttagacccactaacggcatcatgattcctgaaataaaggccgctttgaagccaaattcagtcaatcgatcggtaatcgctgcaaattcatcaaccgctctgtcttcttgaccatacaacttcaagacactgaagccaccgtagttttcctgaacataaccattcatttcacccaaggtattttgttgcccctggaagtaaacctgtgactttttgatgattgctttggaaatcaaaagtgaggccggaatcataattaaagatagtaaagccatccataaattaatcgtcaacatcatgataaccgccataatgattcccaaaattgaggtcacaacttgaattaaactctgttgcaaggcattcgtgattgcatcgacatcattggtaactcgcgacaagatattaccttgttgttgtgaatcaaagaaacggactggcaaagcgttcatctgtagattgatatcccgccgtaaatcacgcattgcgtgttgcactgcacgcgtcattaaaaacgatcccaaaaacatcattgtttgataaagtaacgcaaagctgagaatcatcgcgatgactttagtaatgtaactaaagttaacggcgacgtgttgcgctaagttttgactaatttcagtcactgctagtcccatgataaatggccacaacgcattcgctaaaacggaaatcaccgttgcggtaattgctgaccagaacgttattttataaggcccaatatagcgcatcaggcgtttgagcaccttaatattcttcatttaatattcttcattgagctcctcctttgacaactgtgaggcggcaatggcccggtaaacctcatttgttttaagtaattctttgtgggtaccgatgcccacaacttgtccttcatttaagacgacaatccgatctgcattcataatcgtccccacacgttgggcgacaattaagacggttgcctctttcgtaatcgattttaaagcgcctcgtaatgctgcgtctgtttggtaatccaaggctgaaaagctatcgtcaaagacgtagatatccggacgacgaacaattgctctggcaatcgctagtcgttgcttttgaccacctgataagttgttaccaccttcagccaaataagtttggagaccgtctggtttttccgccacgaatgttttggattgagcaatcgttaaagcatcccataactcagcatccgtcgcttccggattaccatagcgcaagttatccgcaatcgtgccggtaaagaggaccgccttttggggaataaaaccaattttttggcgtaatgctttcaattggtaatcacgaacatcgtaaccatcaatcatcacttgcccccgcgtcacatcgaaaaagcgtggaatcaactgaattaaggttgatttaccactccctgtactaccgatgaaggcgacagtttcacctggatgggctttaaaactgacatcccgaatgaccggactttctgtcggaccaggataagcaaacgacacattttcaaaagccaattcgccttgggtagtcgtagtttgaatcccctgatcatcatccgtaatatctacgggtgaattaaggactttttcaatccgttcagctgaaacagccgctctagggtacatcatgaagacactcgcaaagagcatgaatgaaaatagtacatggaaaatgtattcaataaaggcgattaacgtccccactgctaagtgaccggtattaatttgaaccgccccttgccaaatgattaacacgaacacaatattgaagataaatgaaaagccaggttgtgcgagggctactaatgtaaagagtttgattgaactctgactgtaggcttcattaacttttctaaaacgcatactctggaatttttcacgcacaaatgcgcgaataacccgaatcccagttaaattttcacgtaagtttaaattgattgcatctaagtttttttgttgttctgcagacattggttcggataaccaaccaatgataaccaccccaactaataaaatcggaatggctgcaaaaacaatccatgataatgacagactcgtccgcacaatcatgaacgcactggcaacgatcatcatcggggtcataaaacccgttcgtaacacttgcaccatgaattgcgtcacttgaaacgcatcgttggtcgtccgagtaattaaggaagacacgccaaactcaccatattcatgatgtgaaaattgcatcgtttttttaaagatatcgttccggatatcacgcgttaaattagtggttaagcgactccccgtgtaggctaagccgatcaaacccactaggccaatcagggaaatgacgaccattaaagtcccatattgccaaaccggcccgaccgtatggcggttgatacctttatcgataatttgtcctaataatgttggtaatcccagttcaattaaaataaacccaaatacgcagataaaattccaaaataacagttttttatagcgaatggtatagcgccacattaatttcatttagtccattactcgtgccatatccttgacgtattcaatcgtttctcgattgacaataaatgccacgtcaaaatggtaatcctgatccaataaccaagcgtctgtaatgactaacgctgggtatttaggattaacggaggcaattcgtcgttcgtcggcaacctcatttaaggtctgttctaacgtttccgtaattggcttcaacgacatatccgttcgtaaaacgtttacgcgatactcaaacaacatcacattcccaccccaaacttctgtcggtgaattagcaattaacgttgcttgttgtgtataaaattgcggttgtgcagtcaatagcctttgataagcaatattgacaatctcgtctaccgtttcttgactactactttgtaaaatccgcatggctctttgccgacgaatccggtgaataaaccaagccagaccgcccgccaatccaattaagactagtagtaataaccaaattaacatttgatttataaagtacttttccaagcagacaaaacacaaagtcctctacgcgaggcaactaaatcactctatcttgaagctaacagtgccgttgaagcacgtcaacttgttgaagacaatacaccctacaatattgaatttgtacaagaacttactggtgaacatttagcttacgaacaagaatcagaagacttcaaattaacggagttctaaatgaaactcaatataaaaaacaatgaaacagccgtttttgccgtagggggtcttggcgaaattggtaagaacatgtacggtgttcaattccaagatgaaattatcgttattgacgccggcatcaagtttccagaagatgaattattaggcattgactatgtcatttccgattatcaatatcttcaaaagaatcaacaaaaaatcaaagcccttgtcatcacccatggtcatgaagatcatattggtgggttgcctttcttcttacaacaagtgccaaacgtccctgtttatgcaggtcctttagcccttgctttaattcgtggcaagttggaagaacacggtcttttgcggtctactgaactacatgaaataaacgaagataccgtccttaaattccgcaaaacaagtgttgatttcttccgaacaacccattcaattcctgatacattaggggttgcgattcatacacctcaaggggttgttgttgaaactggtgattttaagtttgacttaacacctgttggtaatcaaccttctcctaatcttcaaaagatggcacgtctcggcgaagaaggcgtcctctgcctaatgtctgatagtaccaacgctgaagtacctaacttcacgaaatcagaacgttttgttggcaattcaatccgccacattgtagaacggattgaaggccggattatcttcgcaactttcgcttctaatatttcacgggtctcacaagcaacagatgcagcgattgctaatggtcgtaagattgcggtcttcggtcgtagtatggaagctgccgttgttaatggtcgtgaattaggttatttaaatattcctgatgaagcacttgttgatgcaagtcaacttaactcattacctgctgataaagtgatgattatctgtaccggttctcaaggtgaaccaatggctgctttaagccggattgctaatggtactcaccgtcagatttcaatccaacctggcgatacagttgttttctcaagtaatccaattcctgggaatacaacgagtgttaaccacgttatcaataagctttctgaagcaggcgctgaagttatccatggtaaagtcaacaacattcatacttctggtcatggtggccaagaagaacaaaaattgatgttacgtttgatgaaacctaagttcttcatgccttgtcatggtgaataccggatgcaaaagattcataccgaactcgcccaacaatgtggcgttgaaccggacaattgtttcatccttgaaaatggtgatgtcttagccttaactgctgactcagcacatgttgctggccatttcagtgccgacgacgtttatgttgatggtaacgggattggtgatatcggtaatgttgtccttcgcgatcgtaaaatgctttctgaagaaggcttggtcgtggttgtcgcaaccattaacttcggtgagaaaaatattcttgccggtcctgatattctttcacggggctttgtctatatgcgtgaatctggtgaattgatcagcgaagcccaacgacgggttttcagaatgatcgtcaacacgttcaatgctaacgacaaggtcactgaaagccaagtccgagaagcaattattgatggccttcaagatttcctatttgaaaagacggaacgccatccaatgattttaccaatgatcattcaaagtaacgaataaatggctgatacgcctcatttttatattattttaaaccaagttgctggtactggccgagctcagaagatttggccgcagattgaaaccgtcctcaagcaacgcggcatttcatacgaactacaaatttctagctatcccggccataccactcggattgcctaccaatttgctcgctttaaacgaaccaatcaagttttactaattatcggtggtgatggtactttaaaccaagcaattaacggtgttcagaacgccggcaaaaccgacattcccatcgcttatttaccttgtggttccggcaatgacttcgcccgcggaattggcttaaatagtgatccactacaagcccttgaacagattcttgcaactagcgcccccgtcaatatcgatttgggtgtttatcatgatgcccttaaggacgagaccggttatttcgtcaacaatgtcggtattggttttgacgcttccgtcgtcagcatcaccaataactctaaaagcaaacgttttttaaataagtttcatattggctccctgtcttacgtcttctcactaatccaagcctttacgtcacaagatgctttccaagttaccgtcaaggctaatggcactgttaaaaatttcagccgaggttttctagtcacaacgacgaatcatccttactttggcggtggtgttcccattatgccttctgcacgcgtcgatgatcaaaaactggaccttgtggtgatagagaagttgaacgttttctttttctgctacctatttattatgatgttaatgggtaagcacactcgctacaaagctgttcatcattttagagccgacgatcttgttgttcgaacccaaacgttagaattcggccaggtcgatggcgaagaaatgggtagtcgcgcatttgacatgcactttaacgtcacttctcaacccttctggctaacaacagaccaaactgaacaattcaaataattatttgtaaaaatcagcttgaactcgtttaaaaatcgttgtttcctttaatttaaacaagaataaccaagcgattaggctgcccgaaatggcaccgccaaaaaagcgtggtgtgtaaacgaaccaaaataaaccgttagcactacccgtaaaccaaatcatgattggataagaaagtaatgagccaattaaacccgttcctagaatttcacccgcaattgcccaaccaatatgaccaccataccgataaccaagaccagctaataaagcaccaaaaagagcccccgttaaggctaaaggcggaatccccagtaacatcattcttaaaatagcagtcaccaacgccattacgattacataaaccgggcccattaacaccgccgcagtaacgttcagaacactcgacatcggcgccatcccctcaatacgaaataatggcgacaagatgacatctagtgcaatcatcatcgcaaggatggttaatcgcttcgttcggctattgttcatctattgttcatcgtattcgtccccacgcaaccattgttccttgcgataagccatctcccagaagtggtattccaattggctgctacgaacaaacgcctgcaccattttaacctgatcatcagctgaactcgatgcatacaagcgatttaaaacaatacccgtcatttgaatttcatcctgcagttcagccttcgtataggtttcaatccagcgttgatagtatggattgggtgaagctggctgttgacttaaagccattccgatatcactgtataaccaagcacaagggtataggccagccgccgcgattgcgggattatccgcaaataattgtcgatacatatgagcaatatagtgatcagttgtcggcgcaacgggtgtttcttgaacctcatcagccgttatttttaaggcttcaaaaaattgttcccgaacgatcatttcaccatctttcaaaccagttgcacttagtgtcatcaacgcttttaattcttgatcttgacatcgatcggagacgatttgatgtaattttctgaaataacgaagataataatgatcttgaatcaaataataccggaatatttcttctggcaacgtccccgcttgcagttgaacgataaacggatgacgtaaactaccttcccaatatggtgcgactttctcttgaacaatacttgtaaatgacatttacctatttttctccataacgaagttggtcaataaaacaccttgccgtgctacttgttgttctcgaatcacttgatagccccgactttcaaagaacggtctggccgtaatcgaagcatgtgtgacaactcggcatgcaacagcttgctcgagctgatgacagatagcagtcgcaacgcctcttctttgataatcggcatggacaaataaccgatcgagatagccagcttgatcaatatctccaaaaccaatcaggttatcattttcaagtgcgacaacactgaaatgtgattgcagcgattgatcccactgctttaaatcaggctcaccagtggcccatacagccaactgcgctttcgtataatcgccagcattcactgtatgcactgtcttataaaacagttctgccactgcttgacaatccgcctgctgatagcgtctaatctccaattaaagtttaaaatagggttggaattccgccggtgctttatcttgtgaaaaccaatgattgggtagctcggctggtgcgcttacctgctcttttgcagtgattaagtaacggcaatcaatgtgcatatgggctgcttgctttttcaatggattgtccgggatcttgatcaaattggcatccaccaattgtgcttgctccccgactagcccagtttcctccaataactcgcgtagtaccgtttgaactggcatttcagacggttcaacatggcccgccggtaacaaccattgatgcaggtatggatgccgaaccatcaatagctgattatttttaaatacgagggcactagcggataaatgatattgatcgttgaccgcccgataaaggggccgtttttgttgggccatcaattcactaatcatctgatatttttgtcggtcattaaacgctgctgattgctcagctagccgctgaatttgcgttaacaaatcgttcattcatgagcggaccgccattaatagatctgcttgctgataacctttgaataaattgatcattttatgcgttgccaaaacatcgtgcacgcgcagaatacgggccccctgctcaaccatcaattgttccaataacagcgttgaggttaagcgttctgccatcggataatcaaatttgctttccataaagcttttccgagaaatccccgccataattggcgcacgatacttcattgttggttgaatgctattgagtttaaacagatccagagacgctgtatttttagcgtgtgaaaaaccaaccccaggatccaaagcgatttgttggcgcgttaaaccggccgcttccaaacttgctaacgtctcttggtaaaattgatcgagcgtttcaaaaacgtcattttgataatggcggccattatacatcgtgaccactgcgggtcgatggttggcgacgacctcgagcttagccgcgttatcgaaaccatcgatatcattcagaattggcacgccgcttgcgactgcccgttgcataacatccgcattattggtatcaactgccaacaccgcgctgggccattcctgttgcactgccgcaatcacgggtgcaatccgttgccattcttcatcaggcgtaatttcttgataacctgggcgcgtcgatttgccaccgacttcaatcaccactgcaccattggccaaatcagcttcgattttcgtcataatctgacccagcgcttgactcggttgaccatcataaaaagaatctggtgtacagttaataatcgcgtagacaatcggatcaaccgttaaatcgaacttgaaaccagggccggtccataaaatttgcttggcgtgccaaatttgtgttaactgcgcatttggctgaccaaaatattgcgaccaattttgctgtaacgccgctagttgaaaaagactaaactgaccaagccattgttggtccaattgttgaattaaacaatgattggctaaacaaagtcgctgtaatttttcgatttcaactgcatccccactaaatttcaaaaggatggcgttcaattgactgggttgtgcttcgctaatttgcatctagctcaaaaagtgttgccgaactgtctttaataaataaaatgaccctacaactaagatgacttgcggtttattccccgttgcaggttgactagccgcctttaaagccgcttcaattgctggatattcaggtgctgtttggcctgttatctgcgtgtatagcgcccctaattcagcaactggtaattgtcggtcatcttgattgatgggggtcgttaaaataaaccgcgctggtagttgcgttaaaagctgcaagcattcagcaaccgccttatcttttaaaaagccagttacaatcgttaaatcgtaaccaccatagcgttcttggacactccggacaaactgccgaatgccatccggattatgggcaccatcaatcacgactagcggttccgttgccaggcgctcaaagcggcctggtaagcggacctgccccaaagcacgttgtaagacgatttcgtctaccgcgtgcccttgatcacgacaaaactgccgataccacgtcaataccgttagcaggttctctaattgataggtccccgccaatgccaaagaaaccgttaatggttcacgctctggtaatttaaccgtcacttcttggccagcactggttggatgacttgtcacgaaccaatcacgaggggcaatctgaagcagtgctgattgccgcttagcttcagcctctaaaacgtgcaaagccgttttcgtttgttcgggagccacaataaccggtgtctgtggccggataattttggatttagtcgtagcgattgcttcaatcgtatcgcccaatagcgccatatgatcgagactgatcttcgtaaatagcgtgtaggccactcgatcaaccgcattggttgcatctaactcgccacccaagccacattcccacaggacataatcgacttgttgctgcttaaaatagaccaacgccaccaatactaatgtttcaaagtacgataagtccgtcgtcggatcaaagccaagtttttttaaaacggtttggaccgtcgccaataatcgctcaaactgcgcttttgaaatcaactgccggttaatctgaatactttcctcgactgccatgatgtgcggactcgtaaataaccccacggagtagccggatgcttgcagaattgccgcaatcatcgcactcgttgagcccttgccattcgttccgcacacatgaataatcgaaaaagcatgatctggctgccccatcgcttttaaaatctggcgcaagagcgtcacccgctcgtcttcaccatataacatccctggtaattgtgtgaccatttcctcatcttgcatctatttcaatagttgtagaaattcgctgcgtaattggcggtcggttttaaaattgccgctgtaaaaagtcgtatgggtctgactattggccttcttaatgccgcgcatctcaacacacatatggcgcgccgtcacttgaaccgcaaccccgtgtggctttaatatttgatttaaaatttgtccgatatcacgcgttaaattctcctgaacactcaatctttttgaaacgaaatccactaaccggggaattttactcaagccgataatctgcccattggctggcaaataggccacactgacctgaccaaaaaagggcaacatgtggtgctcacacattgaataaaacggaatgtcctgcatcatcaccatctgatcatcgtcggtctcttcagtttcgaacaacttatagtctttaaagatggtttctccttgatacgccaaaacttctccgtacattttagcgactcgttgtggggtttctaacacgccagcacgctcaggatcatcgccaacttgctttaaaatatcacgcacatctttttcaatttgctgatttgcttgttctatcattcaatttgctgatttgcttgttctatcatcgtttacctcttctaatcgtttaatcgtctgggtttgatcctgcttcaagacatcaatctggatttcaatcgcagctttttgataaaagtcggccccacagatttctaggattggcactagcacaaatagtcgcttgaaagcttctggatggggaatcactaacgtatcactttgtaagaccagctcattaaagaaaataatatctaggtccaacgtccgcggtccccagtgaattgttcgttcacgccgacacgcccgctcaatttgatgtaagacaaccaacaactgatccggcgtataatcggtactgatttttaaagcgccgttgataaaatcggcctgttcaactggacccaccggcgcggtttggtaaaaggctgaccggcgttcaatttgaattttcgaatcgactgtcaaaagggctagcgcctggttaatattcgcctttaaatcacccatattactgccgtaactaatataaacttgattgctcaatcaaccctccatctcgatttcgacatggtcaaaaataccttcaattggcaccgcaatcttgcgcaccttaaccgcaactaagccaatccgatcaggatcaagggcgtgaattgcctggataatctcatgagcgattgtttcgaccaaattagcgcgtgatttggcgattaattgggcaatcacttcataaaaatcagcataactgaccgtatccgttaattcgtctccttgataaggcgtcataattgccacctttaaatcaatttcaatacgctgacctagatccttctcagcttgaaaaacaccaatatgcgaatgaaactgcatattattaattttaatatgatacatatgttatcgaatcaattagcaaccacctcagactatgcgctagtcctcgatatttgggaacagtccgttttagcgacgcataatttcttacaacctgaagacgtaaccttttataaaacacaaatcccccaattcctggatcaaacggttctcagaatctggtcactagataaccaacctattggttttagtggtaccaacggtcaagaattagagatgctatttctcgaccctcattacattggtggcgggtatggccatcaaatcttagactggctaatcaataatcaacggattaataaaattgatgtaaacgaacaaaatcaacgtgccaaagcgttctacttaaagcacggttttacagttgtatcacggagtcagcgagatggctttgataaaccatatccgattttacatttgacaagataattagaccgttctacattgcagtgccacgttctgaccaccaaccattaaacagccgcaaccgaccatttctgccagctgggcgtccaattgaaccatcacatcatgaattgttcttagatccgcacgtggttcgtgacgacaaataaacaacggtaaatcgttacgcgtgtaataataactcatctgtcccacaataccaacgcctactttagacaacatgacgttcccagtctcatttaacgttaaagaatactgatcattaatccgtgctggttcaaattgtttcatatgaagactttagacaatatcgctcttgccttattaatcgtaggcggtttaaactggctacttgttggtttatttaaattcgaccttgtggctatgctatttggcggccaagcagctattatttcacgaattgtttatgtcctagttggactaagtgcgctctactgtattaaattatttgctaatatcaataacatggcacgttaactataaaattctcttcccataaactctatattctccatcttcttcatggattctattaatataatttctatctaaatacgtatctaaaattagtttgtttattttattaacttcaaatttaggtcttttccccttgagtacattaataaactcaataggaaagtctaactttttaatgaaaactaacagttcattaaaagtcatcatttcaacattgacagcaaataacaacttcttattttcagtttgctcatctaataatagtcgtaccaataatgccttatctactacatactcattttcaatgattatatttatattctctaaagctctatcatatatagcctgttgtaatttcgtatttacgttagcgtatgaacttattaactcaggtaaatcactttctttgaacttatgctgaactatataagccttaatatccttaggatagctactatttaaaattgatatattttcctttgaagtatcaattaaccctttcttttctttttcagttaggttttcatttgctattaatttaattaataccgattgattgtaacaatcctcttgaccaaaaacatctataaaagtattcatatcacgttttacaaacgcgtatacgacctcctcatattttttcataatagctacaatatttggcatagtaacttctattattccggctagaattagttcttttattttctctatctggataccttctttattaaatccatccttatatactaattcaaaagatttcaaaatcgatatatatttatgcgtatctatactattcttaataaccaggttatcgtagagacttgataatatttcttcggcatatctacctttaatcgtttgaaaatttaattcaatattattcgtatttattttatcaacaagactatcattcacttgattttcactaagaagaaaatattcaataatattctcttcgctaactaagatatttcctgagtcaaatagcatttttctctgtgacaaatcttttacagagttaatctcatttatttttttaggtaattctaatcgatcaataacaccactgctattttcactagataaactaggattattcattaattccactattatttctggagtttcacgtaataattcgttagataaacttaaatatagattaatgtattcatttaattgattttcatatatgtttaccttaagaatttcttctgataataatagagatatattatcagaataaaatcttttgttaatatccagttcataaaccataaaagcatttttcagattattttctgaaagttgaaacatatttagttctactatttttttcgtttgaatttttgttgcatttatttccatgaattttatatttaatttacttaacctttttaaatagtcctctgaaggtatatcacttacttttaaatattcttcaaaatcactagattgctcaataaaatctttaatcttaattgttgaatcattatccttaacactcgaatcagaaaaatagaatatagcaatataaataaattcctctatttttaatcttttttctaaatttaatgaaattaaatctttaagaactaaattccacttagactccaatattccgaagaagttcaaaagtttcttttcctctttaaatcgttcatagatatctagtatatatacactagattcactatttctaataacattaaatatcgctgtaacctcggagtcatatttatccatattttcaatataaaatatagataagtctaaattcaatactttaaatctaattaattcttcaactgataattcagtcgttattctgtcaaaattagttagactataagtccattccttcggtcttctatcatagattcctcttaaaaattctttgtcctcaatatttaagttattttcataaaaatacgttaaataatctgtataattttcatcaattaacccttctctaacgataaatataatcaaatcaaaatatggacttttaataagattttcatcgcattcaagtttattgataaagtcgttaagatcaatctctgaagaaagcaatacatcagacatggattcactatatactttctccatttgggtacatctactttatcacgttttcaacgtggcgcactagcacaactggtcaatgaggggaataaatcttaccaagtaatggctgacgccttaggcgtcgccaaagctacgattagctatgagttggaccgagttaaaccttatgatccagaattagctcagcaagatgcagatcgcaaaaggcggaattgcggtcgtcgttcgatgctgacggcagcattagcgactttaattaccaatcacttacgattaacctggtcaccagaaaccattgcggccgcttataacttgagcactgcgtcaatttataattggcttaatcgtggctggctccccttcaaattgactgatctacccaatcggaatgtccgccagcaccgagtgagcgaaaatcgtgggaaatttacaagtgggacttccatcgaacaacggccaacaactgttaatcaacggttagcttttggtcattgggaagtagatacggtgctttctagtcgaagtgagtcacgatcatgtctggttacattcgtagaacgtaagacccgacttctatgggccatcaaagcccctaatagaacggctaaggctctaaacaccgcctttggcaagtttatgggggccttcggtccccaagtaaaatccattactgttgatcatggtaaagagtttgccaattatcaggccttagaacaggattatcagatcaaagtttatttttgccatccatattcaccatgggagcgaggttccaatgaatattttaatagacggttacgctggttcttcccgaaaaagaccaattttagccaagtaacgactgatgagatcctagcagcacttgaactaattaatcaacgaccattaaaaatacatcatcaacagactgccattgaaagattccgggcttgttcggattaattaatcaacgaccattaaaaatacatcatcaacagactgccattgaaagattccgggcttgttcggattaaacttgtaatttgccaacttaacaagatattcctttttatcttttaattcttcaaatatccctgaaatattcttagccgatagtgtagttttgagctctgacgagtagtatccggatgtatatgttgcttgtttaacgtcaaaactattattcttaattgctgcaatgaaatctgaccgattttcaaagtctgattcttttttttcattaactgtatagaatccgtctgtaggattctttaaaaataaagcatctaactcattgaccgaatttaatgtctcaatctcagaatcttctaattgcttttctaggttactaatttgcttttctatcttttctattatatcttgaattaaactactcttttttgaaaatatttcattaataaacccaatccctaattgaaatttagaaaagtcttttggaaataaatttttataaataattgtagcgagtaatttattattatccaaagtaatttctgaaagcctatccttataaattaaatattcattactgatattttttagtagtctcatatcatcgatataaagagacagttttcttaaaaccttaatatcaaaatcgttagatattccagcatctttaaaagtctgtatgaattgttcaaaagagtttgacgaatctataactggaattattggaattataaaatcaaataacttagttctatcttttgaagtaaatgcatcatccttaattagataaataaacttaatctgatcctttttcttattaacagctaatctcttattaactaataaattaatttcataaaggcgttcataaatcgttggattattaaatctatctaaatcttcaaaaatgactacgttctttccagaactcgtaaaaaggtatattacatcattcataaatttatcaaaatatgattcattttgatcttgaaatatttcaatttcatttccttttatcgttattttttttaaaaattgcttgtttatttggaatttaataatactatacataaaaaatacgatactcccagtaaatatacacaatactattaaattaaactgctcactagataaaaatttcactaggttcataactaacttaccagaatttttattagtaaacgaaccatttagatatcttgtccagtttttaaatttgacaaccaacagtgcactgcatataaatactaatattagtatcgtatatttccataatgtcgattttttagtattattctttattttaaatatggtttgaggaattttgttataatcaatttgatgtaacaactgatttattatcttaccttctaaaatatttgtcccagttgcttcattcccttcaaaatgcgttaaggaaatattcataaagcccttttccggatgtttcattttgtaagattcaataacagagcttttacctgcaccatatggacctgtcaacgcaatattcgtaattgtcttttcggctagggcaaaacttaaagcctcctcatatgttgatatatcaatatcatttttcggtgttaacgattcaaaattcttctccaattagacagcctttataatatcttttttgtatagattcccaactgcatccatataaactaaacaaatctctctatctttagaccaattattattaatatattctaaaggtatagaaatttcactagaaacgcaatgcggttctattaactcaaattttctttcttctaatcctataaccacttcaagaacgggatcaataatatagttatctatatttttactttttaagttatcatgttcggaattgattatttctaaatattgtttcttagtgcatatcccgataaatttaaatgatcctgctgtatttccatcgtttgttccccagaacaacaattcttctttactagtagttatctctattccattttcatcagtgttctttattttccttatacctgaagcaataagtaaattcgattgtttatccaagcgatactgcttatcagattgttttatctgttgatatacagccacaatcgcaaaaatagatcctacaccgcttacccaatcagcaacactcccaaaatcccctttattaaacgaaagtcccattaaagttaaagatatgccgacaaaaaaagctatcatctagcccacggacccttccatttcatagctaatcaatctattcaattccaccgcgtattccattgggagttccttggtgaatggttcgacgaagcccatgatgatcatttcggttgctttggcttccgagatgccacggctcatcaagtaatagagttgttcttctgaaattttggagactttggcttcatgttccattgagacgttcccgtttaagattgtattatacggaatcgtgtcggaactggatttatcatccataataatcgtatcacattcgacgtgggcaaaagaaccgtcactgtctcgttcaaaacgaacagtccctcggtaatcaactgcgcccccgtctttggcaatcgattttgaaacgattgatgaagacgtatttggtgcggcgtgaatcatccgggcaccactgtcttggtcaacgccttcgccggcaacagcgattgacagcattgtcccccgtgcgccttcaccatcgaggtagacacttgggtatttcatggtcattttagaaccgagattcccatcaacccattccattgtcgcgttttccatggcttgggcccgtttggtttccaaactataaacattcttcgaccagttttgaatcgttgtgtatcgacagtaagcatcccgtttaacgaagacttcaacgaccgcagcgtgcaagctatcacttgaataacttggtgcggtacagccttcgacatagttaacactggcgccttcatcaacaacgatcaatgtccgttcgaattggcctgaattttcagcattaatccggaagtatgattggattggaatatccgtccgcacgccttttggtacgtagatgaaagtcccaccagaccagacagccgagttgagcgctgagaatttattgtcggttggtttaaccaaagtactgaagtattccttcacaatatcgggatattcgcgcaaggcagtatccatatcggtaaagataatccccagcttttcaaattcatcgcgcatattgtggtaaaccacttctgattcatattgcgcacttgaaccagctaagtatttccgttcagcctctggaacccctaagcggtcaaaagtatccttgattttatcagggacatcttcccaatcgcggtattgtttatcagttgccttttggtaatacaacatatgctctaaatcaagaccggataaatctgggccaaaatcgggcattggcattttttcgtaagcatggaatgattttaaacggaagtctaacatccattggggttcttttttctcgtgcgaaattgcgcgcacaacatcttcagttaagccccggccggttgaaaagacgggttcaacatcatcgctaaagccgtaatcatagttctcaaattggggcatcgtcgtctcttctgtcatttaatctgttccctccgtttctgcatggttcacaatttgacccgttgtcgctgtgttggtatcgctattgagcgctttgtggagcgccttccaagcaagcgtggcacatttaatccgcgctggaaattgttgaacgccctgcaagatggccgcatcttctagaattgtccaatcttcatcgcgatcaccaatcaccatgtccgaaaagcgttcgatcattacttcagcttcagtaggtgtcttatgcaagaccgcatcggtcatcatgctggcagaggcttggctgattgtgcagccttcccctgaaaaagcaatctggctaatccggttatcttcaagcgcaatctccaactgcaacacatcgccacaagttgggttacgtaattcaatttcatgatcgacagtgtctaaatgaccatgatggtgcggatgttgcgaatggtctaagatgacctgtcgatataagttatctaatttagagagtgccatttagagagtgccattttggaaaaactcctttgctgcttgaatcgcggccactaaggcttgtacgtcttctgacgtattgtagaggtagaaactcgcgcgagccgttgccgcaacgtttagccactgcatcagtggttgtgcgcaatgatgccccgcgcgaacagcgaccccttccatatcgagggctgttgctaaatcgtgcggatggagattgtcgaggttaaaagcaatcacaccggttcgctgactagcttcttgcgggccataaatcgtcaacccgtcaatcgcttgtaaggccggtaatgcctcggcgactaaagcctgctcatgtgcctggatgttggtcatcccaatctgattcagataatcaatcgcagctcctaatccaatcgcgccagcaatattgggggttccaccttctaagcgccaaggcagttctttgaaggtcgattcttgtaagccaacaaaatcgatcatctcaccaccatattcaacgggtgataactgctcaagcaaagcctgcttaccatacaagacaccaattcctgttggccccaacattttatgccctgaaaaagcataaaaatctgcatcgagcgcctgcacattaactggcatatgcgggacagattgtgcgccatcaaccaccatataaccaccttgtgcgtggactagtgccgcaatcgtcttcaccggattgacaacacctaaaacgttagaagcatgcgctaaactgacgattttagtccgtggaccaataacctgcttggcgacgtctaaatctaactgaccatctggtaatagatcgatgtagcgtagtttggcgcccgtctttttagcaagttgttgccaagggactaggttgctgtggtgttccatatagctgatgacgatttcatcgccagcttggacaactgttggtccaaaactgccggcgatccagtttaaactctgcgtggtcccttttgtgaagacaacttccgctgaagaagcggcattgataaattgttggactttaactctagcagcttcgtattgagcagtcgcccgttccgccaacgtatgcacgccccggtgaacattggcattatcatgttgatagtaattcactatttggtcaatcaccgcttgtggcttttgcgttgtcgctgcgttatccaaataaaccaaggattcgtcattaaccaattgttctaaaataggaaaatcttgccgactagtgttcagacttttgcccatctagtgttcagacttttgcccatcgattaacttcctctcgattgtgtccgttaattgttgacgaacatttttgtccggaatttcagtcaggacggcgcctaagaacccacgaataactaagcgttgtgcgacttctttagacaagccccgactcatgagatagtacatttgttgttcattaacacggccaacactggcagcatgaccggcttgaacgtcattttcatcgattaataatagcggattggcatccccacgggccgtccgtgataacatcaagacccggttttcttgttgtgcatcggcacctttagcacctttgatgatgtgcccaatcccgttaaaagttagggtcgcatcttctaaaataacgccatgttgcaagatatggccgattgaacgagggccaatattcgtcacccgcgtatcgattccttgaatttgtttcccagttgaaatggcgaccactttcgtttcagcatgcgaaccatcgccgaccaaatcagaatcaaagtcgccaatgatattgccgtcattcatgaagcccaatgcccaatcaatccgggcatcacgcattaagtgcccccgacgattcagataagtcgtgacagacttaccaaacgcatcaacagctgagaaatgcacgtgactattatccttggcaatcacttcaaccaccatattagctaggttcttgtgatcacccattgtttgtaggttttctagatagctaaactcactattttgttccgccacaattaaaacgtgatggataaaatcagtggcttgcgtgctatcttgtacataataagccgtaatcggttgtttaatcaccacatttttcggtacgtacaagaacatcccactgttcatcaaggctgtgtgaaaggctgtcaaacgatcctcgtccggtttaaccgtcacttgcatatagtattcatgaactaattcaggatagtcttgtaaagcagtgaagatatcggtaaagatgaccccttgttctgccaattcactaggcagatttaatttagcaatcgtttgcccaacttgaatcacataaggttgatccgccgttaaatcagcgaccatttctggtaatgtatcagtcacagaagttgtcaaagttggcgcattcgcagccataattggccaatgtttgtaattaatcttttcgaaaataggtaagtcgagcttttcaatttggcctaaggctgtttggcgtaaggctgcaaaccaatctggttcttgatggacaattgaaaaagccgcaacttgttcaggtgtgatggctaatttctttttcatctatttactttcatcgtcagttaatttaatgtctaaccctaattcatcacgaataccggcgtaaccttcgtcttctagacgtttggccaatgatgcatcaccagtcgtcacgattttaccgcccatcatgatgtgcacgaaatcaggcacaatgtagttcaataaacgttgataatgcgtgataatcaatgaaccgaagttatcgccgcgcatttcattgacccctttagaaacaacttgaagggcatcgatatctaaaccagaatcaatttcatctaaaatagcaaatttaggttcaatcatcattaattgtagaatttcattccgtttcttttcaccaccagaaaagccttcgtttaagtaacgttcagacatttcttctgtcatatctaagacagccatgcgttgatctaattttttcaagaaggccatgatcgagatttgatcatcttcagcccggcgcgcattgatagcagctcgcataaattcagcgttcgtaacaccttgaatttcagatggatattgcatcgctaagaataagccagcgcgtgctcgttcatcaactggcatttcaagaatattttgaccgtctaatttaatttcaccttgaagcacttcatatttaggattacccatgatggtttctgaaagggttgatttcccggtcccatttggtcccatgatggcgtgaatctcacccgtattcatttctaagttaacaccttttaaaatttctttaccgtcaattccgacgtgtaaatcgataatttctaatttagacatttatttaacgggtaataccgccccgtgccattgctttttaatccaggcttgggttgattttgatttgagtgctttgattaacttcttgattgcgggtttgttttcgtcgcctttattaacagcgacgacgttcacgtatggtgatgagaggctttcgattgccactgcatctttttccggtgtgaagccggcttgaaccgcatagtttgaattgatggcaaccagtgtaccttcatcatttttcaacaattcaggcatcaatttcggttcaaatgtgtacttaaatttgagcttcttcggatttttggcgatatcattaaaggttgcattttcaactttgacccctggtttcaaggtgatcaagccgcctgcttttagaatcgagaggacccggccccagtcagtttgactatttgaaactagaacggtagcgccggttttgacggcactcaattttttaactcgcttactataaagacctagtggttccagatgaatcccaccggcactcactaagtgataaccattatcgtggttagcctttttcataaacggaatgtgttggtaatagttggcggtcaattcaccgcttgctaaagccttattaggtaatacataatcactgaacgctttgacatccaatgtgatgccttctttttttaattcgggtttaatgtgtcttaaaatggcggcatgcggaatggttgatgcgccaatcacaatcgtattgggatctgcttttttagcgcgacagccagttaacagtaagccaacaattaaaagcccagcgagtacgcttaaatatcttttttgcatttaacgatgatcaattttagcgatgataatgtcaccggctttttgacaaatgaacacgatgattaaaataatgattgtcgccactaacgtaattgtattttggtttgcttgaaagccttcagtgtaggctaagttccccaagccaccggccccaatcacaccagccattgccgtgtaaccaagtaatgaaatcgcagtgacggttaatccggaaaccagtgcgggcatgctttctggtaaaagaacttgccagataatttgccattttgaagcgcctagtgcgcgggtcgcttcaatcaccccgctatcaacttcacgaaaggctaattctactaaccgcgcataaaatggtgctgccgaaacgattaatgctggaattgcagctttgggaccaatcatggtacccatcaattccttagtcatgggaatcaaaagcacgattaagatgatgaacggcactgaacggaaaacgttgacgaataaagcgacaatcccatttaacaaccgactcataaaatccgttttaccattcgtttgatataagactaatcccaataagaaaccgagaatcgccactagcaagacactaaccgccgttagccaaaccgtttcgcctgtcgcttcccacatcgttggccagtcgatttgtttaaattgaaaataagattgaaacccgttgatattagccatttagccatgtcttaacacctctacttcgatagtttgttgacttaagtcggataatgcttgttttaaatcgtctggactagcttgaatctgaatgtataaataccccagggcgccattaatcgtttgttgtaaactcccactaatcacgctgacttcaacacttgggtagcggcgcattaattggccaataactggctgactcgattgttcttcgttaaaccggagcttgacgatcgtgccctctggtacccgcgtcaacaactgttcgattgaagcggctgtttcgctaggcgtaatcaccaatgattctgaaacaaaggctttcgtcacttctgcctgtggcgtttcgaaaatcgcttgtgtcgtcccttcttcaatcacccgaccggctgccatcactgcgattcgttggcagatccggcgtaccgcatccatttcgtgggttaccagcacaatcgtgatgcccatttcctgattaatcttagctaaaagacttaaaattgaattcgttgttttaggatccaaagcactggttgcttcatcacataacaagatggccggttcgctgattaatgcacgggcaatcgcgacccgttgcttttggccccctgaaagttcgctaggataagcggcgcccaagtctgttagctcaactaatgccaacatctctttggccttagctaagcgttccttcttgccaacccccgctaatttaagcggtaaggcgatattttcaagaattgtttttgaccagagtagattgaagtgttgaaaaatcatgccaatcttttgccgaattggtcgcattgcttgttcgctcaaaccaacgattgattgaccgttgaccaagacatccccgctagttggtttttccaaaccgtttaataatcgaattaacgtactcttaccagcgcctgaataaccgataatgccataaatttcacccgcttcaattttcaatgaaatatcgctgagtgctgtaaatgtctgttgttctcgttggtaaaccttaccaacttgctttagttctaacatctaattatcagaaattcgaatatcggcaatccacgcatctttttcattatccgcatttaataattcgggattatcggctaaatcagtattgacattgactaattcacccgctaaaggactatccaactcttgaaccattttttcagcttcaatcgcaacaagtggcatatcaagtgccatcttttgcccttcaactgggacatctacaaatttaattaacccaaattcattttgcgcacccttagtcaaaccaattcgtctgattgaagctgcgatttcttctgtccaaaaataatcattgttactcatctagaaagtatcttcagattcgctgaacatataactcttataatggtaccgcatcgacatgataaagccaatccccatcatgttccccaatagcgatgaaccaccttgtgaaataaatggtaatggaataccggtcaatggtaatagaccaacactcatcccaatattttcaaaaacatggaaaagaatcatcatgataacacccgttgaaacataggcataaaactcatttttggtatcaaatgtgacccgaatcatttggtagatcaacaagaaatacaacaaaatgactaaacaagaaccgatgaagccgaagttttcaccaattacggagaaaatcatatcagattcacgaaccggtacattaacctgaatttgattgaagcctttaccaaataattgaccagacccgatggcctttaaactttgagataattgcaaacttgtgctggccgtattatcaaacggatgtaaccaggcatcaattcggttaaattgataggttttaaagcctaagtgggttaaaatcgcccgccctggggttgttgcagccaaggtcaaagccgtcccaccaatggccgccattatagccattgcaggtgctaaaatcttccaagtaatcccagatactaagataatgccacccaaaattgcgacgaacaccaataatgtcccaaaatcattttgtaatttcaaaagtaccataactggtaatgtccaaattaataatcggcctaacaataaccaatccgtattaatcgtgtgttctggatactcggtattgtgcttagtgacaacccgactcatcattaagatataagccggcttcatcacttcggaaggctggaacgaaatcggccctagcgcgaaccaactcttagcaccagtttgaatcgcaaccgatttattataaaagaataaaacggcaactaagaggaaaatcccaatgccataagcaatcggcgcaactcgccagagctgttccgaatcaaactgcatgatggccacaattgcgatcccaccaatgacgtaccaagccgcctgcatcagcacagctcgcgttgagctggcactacttgtatcatgcgttaccgcgacataaatcgacattaaacccactaacgctaacataaagacggaaaaaacaatcccgtaatctacacgcgaagtatcgtcgactttttctaattcctttggcatttaaccttggtgtaagtgatactcccgtagtaattcgttaacagcatcgtcgtgtgttttagtaatgatgctttggccagtaccttcgacagttgcttcgaaccgttttttagcactatcttcgataataacaccgacttcgtttttgccaactttgacactcgtcattgcctggccgttacggttaatatcatcaattgtgacttctacgcgttgttcttttttagacatctactgcaagaaattaataatgtgactccaggtacttggtaaaaagacggcaaatgggttttgaccacccattgcaaaaccaatcatttgaccaattaacccagcgaaaatcattaaaacaatgactagtaagatctttttaagaactggtttgacgtgctcttcaaaatttgatcgatacacaatattcacttagtgtgctcgtttttgggcaatattttctaataaaacacccgtacctaaggcaactgcgtccaatggcttttcagctaagacaactgggaccttaaggtgttcagaaaagaggttggcaatattgcgtaatagcgcgccaccaccggttaacataatcccgcgatcaataatatcaccggctaattctggtggtgtcacttcaagcacttctttagcagcggcaacaatggccatcattgtttcgtgcaaggcaagctcaacttcatccgcaccaatcgtgattgacactggtaaaccaccgacaatatcacggccacggacttctagttgttcacttgcatcagcatgccaaacactaccaatcttcaacttgattgtttcggcagtatgttcaccgattaataagttatgtttacgtttaacgtatgctgcgatttcagcattcatgcgatcaccagcaagccgtaatgaacgacttgtcacaacttcacccattgatagtacggcgatatcactcgtcccaccaccaatatcgatcaccatgttaccgcgtggttggaaaatatccatcccagcacccacggccgcaaccttaggttcaaattctaagaaaactttaccgccgccagatttttctgcagcttctacaattgctttttgttcaatcgatgtaatatttgttggacaacaaattaagatgtttggttttgatagaaaacctttgacgtttaatttattaatgaaataagcaagcattgcttcggtcatatcaaaatcagcaatcacaccatctttaagtgggcgcactgccaaaatattgccgggtgtccgaccgaccatgctgtatgcttcagaaccaactgctaatactttttttgttttagtatcgatcgcaacgactgaaggttcattaagaacaatgcctttgtccataacgttaattaagacgttggctgtccctaaatcaattccgatatctttagccatttaagctaatttttgagttgttttacgatgaccggcttcatcaaaatcagcacgactgatatgtgcgcctaaggcacgtaatttttgatggaagtgataataaccacgatccatgtattgtaggtttgtgacaagtgtctcaccattggccactaaaccagcaatcactaatgctgctgctgctcgtaaatcagaagcggccacttcagcacccgttaattcagtaggaccgtataagatgacagattggccttcgatttggtaatcggcattcatacgtcgtaattcttctaagtgcatgaaacgattctcgaagactgtttcagtcatgacactcgtcccatgagccatcaattgtaaagcggtcatttgtgcttgcatatccgttgggaaaccaggatatggcaaggttttgatattacttggtttcaattcatcagggccgataatccggatgccattttcttcctcgatgacttgtgcgcccatttcagctagtttagacaataaaggtttattatgttcagaaatagcttcttcaactaaaacattacccttagtagctgctgcggtaatcatgaaggtccctgcttcaattcgatcttgcacaatactgtgttcggtcccctttaattcagtaaccccttcaatccgaatttcttcagtcccagcaccgaaaactttggcgcccatcttattcaagacgttagctaaatcaacgatttctggttcgcgggcaacgttttcgatgactgttgtgcccttagctaaggttgctgccatcatgatattttgcgttgcaccaacacttggaaagtctaaatagatgtttgcaccaactaattggtcggccttggcttctatgtaaccatgactttgtgtaatcgttgcgccgagtgcttcaaaacccttgaggtgtaagtcaactggtcttgaaccaattgcacagccacctggcatggcaactcgggcatgacccaatcttgctaataatggtcccatgacaacaattgaggcccgcatctttgaaacatattcgaatgccgcttcaaagtttagtggttgattggcatcaatcattagatagttacgttgttcatcaaatttaacacgtgcatccagactcttcaaaacatcttgcatcataaaaacatctgataagattggcacgttcgttaattcaactggtcctttagaggctaaaagtgccgctgccatgattggtaagactgcatttttagcaccttcgatgtggacatcaccaactaatggttgtccgccttgtatgatcaatttttccaattattggactaaaaaaatgatattgcgcgcttgcgcgataatttctaaaaagaattgactcactaaataacccattacgatggctgtaaacatgagaacaatctgaatctgtcgaatatgattcggtttaaaaagctgttcaagtcgtaaagactgtagaccgtaaaaactaagaacgataaagccgatatgactaataatggtaacaactgcttgtgatccaattgattgcacctattgtaaatgatttttgacgtcaatccggttcatcgcgcgttgaagtgcgatttgagcccgacgtaattcgtctgaatcatgtttttctgaagccgtcttaatagcgtcttcagcacgttgtttagcacgttgggcacgtgataagttaatatcgcgcgcacgttcggcaccatcagcaacgattgaagcgatgttatgactaacttccataaagccgccagtaattgcaatggcgtcttcatgccctgggttatccgtccgcttaacacgaatttcaccaatttctagaggggtaataattggctcatgattagccataataccgagttgtcctgccattgctggtacaaccaacattgaagcatggtgatcataaacgacaccatcaggagttacgatattaacggttaataccttttgctcttctgccatctagtcttgatcgacagccttttcagactgtgtatagcccatttcttttgcctttgctaatgcagcgtcaatgttcccaacaagacggaatgcttcttctgggacatcatcgtagtcacccgcaaggatggctttgaaaccagaaacagtatccttaactggcacgtatgaaccggcttggcctgtgaaggcttcggcaacgtggaagttttgtgataggaagaattgaatccgacgagcacgtgcaacgataatcttttcatcatcagataattcatccatacctaagatagagatgatatcttgtaattcacgataacgttgtaagacgtgttgtacttcagaagcaacttcataatgttcttggccaacaatttcaggatcaagcgcactagaagatgattctagtgggttaacagcagggtaaataccttgttgtgttaacttacgatccaagttagttgtggcatccaaatgcgcgaaagttgtcgcaggcgcaggatcagtataatcatcggcaggcacataaatggcttggatagatgtaactgaaccttttttagttgatgtgattcgttcttgtaattgacccatttctgttgccaatgttggttggtacccaacggctgaaggcatccgtcctaatagggcagaaacttctgaaccagcttgcgtgaaacggaagatattatcaatgaacaatagcacatcttggccttcaacatcacggaagtattcagcaattgttaaaccagtcaaggcaacacgcatacgtgcaccaggtgattcattcatttgaccgaaaaccatggctgtcttttccaaaacgcctgattctttcatttcaaagtataagtcattaccttcacgtgttcgttcaccaacaccagtaaagacagaaataccaccatgttcttcagcgatattatggattaattcttggattaagacggttttaccaacaccggcaccaccgaacaaaccgattttaccaccacgcacataaggggcaagtaaatcgataaccttaatccctgtttctagaatttctgaacttgtatttaattcctcaaatttaggcgcagaacggtgaatactgtcgcgtctaaaatctgcaggaaattcttcgccgccatcgattgtttcgcctaagacgttgaaaacacgtcctagagtttctttaccgactggtacgttaattgcacgtccagcatcttcaacaggcatgccacgacgtaaaccgtcagtagattccattgaaattgtacgcattaccccgtcgcctaattctagagcaacctctaaaacgacagtttcatcattacctttatcgactgttaaggcattattgatatctggtaaatccgtatctaaagaaaattcgacatcgacaacgggaccaataacttggacaacttttcccatactcatttattctaatgctgccgcaccaccgacgatttcggtgatttcagttgtaatttgagcttgacgtgcacggttatatttaattgataattctgaaattaaattattcgcgttatcggtcgcactcttcattgctgccattgaagcagcatgttctgctgttttagaatctaacattgcgccataaattaagctttcggcgtattgcggtagaattgcgtctaaggcatcatccacggaaggttccgtaatgtattctagattttgatcagcaacttctgaaacatctaagtcggtaattggtaacattttttcagctctaaagccagatgttaatgagttaacatggtggttgtaacaaacgtacaactcatcgtaaacaccattatcatacatcgcaacggccgttttaataatttgtttaacttcttcaaaagaagggacatcactgacaccacgatattcgtaagttaagttcatgccacgtgctttaaagaaatcagcaccagtcccgccgaccgcaagaattgcgtattcgtcaggtgattgatgcgtttctgaaatcatttggaccattgcttttaggattgagctgttatatgcaccaactaagcctcgatcacttgtaataactaagtaaccagttttcttaattggtctttccactaacaaattactcaacgttacttcgtgcttgatcgcctttttaatagttgaatcagcaggttctgcttgtaaactactcttttgacgagcaatgtcaattaattgacttgcagctagatgcgtcacgatttctcgaatcttatcagtataaacttggtaagcaactgagttcttttcgatttgagaaagcttagcaccagaaaccatttgcatagcacttgtaatttgcccagtttttttagtagaggcgattcttcgtttgatatccattaaagattcagccaattacttatctgagtctttgtcatcgacagcttgttctggtacaaaaccttctgtgaaggctttaatagcagcatcaagtttgtctgtgtctggcaatttagttgtttgacggatttcatccatcaagtctttagcgttactttctagataatcatttaaaccactttcataacgcatgatgtcatcaacaggtacatcatcgatgaaaccgtgtgttaaggcatataggattaccgtttgttgttcaaatggtaatggtttatgcaatggttgtttcaagacttcaacagtccgtttaccacgatttagtttggcttgtgttgcggcatctaaatcagaaccgaattgcgtaaaggcttctagttcacggtatgatgaaaggtcaagacgtaatgtcccagaaactttcttcatagccttggtttgagctgccccaccaacacgagaaacagatgaaccagcatcgatagctggacgtgttcctgaatagaataaatcactttccaagaagatttgaccatctgtgatcgagataacgttagttgggatataagctgaaatatcaccagcttgtgtttcgatgataggtaaagcagtcattgaaccgccacctaattcatcacttaacttagcagcacgttctagtaaacgtgaatgtaagtagaagatatcaccagggtaagcttcacggcctggaggtcttcttaaaagtaatgagatttcacgataagcagcagcttgtttacttaaatcatcatagacgattaaaacgtgcttgccgttatacatgaattcttcacccattgctgcaccagcataaggggcaatgtacaagagtggtgcgggttggctagggccagcttcgacaacaattgtataatccattgcaccataacgccgtaaggtttcaacttgtgttctaacagttgattccttttgaccaatggcaacgtagatacaaatcatatcttgacctttttggttaataatcgtatcgatcgcaacagatgttttaccagtcttacgatccccgatgattaattcacgttggccacgaccaattggcaccaaggcatcaatcgcttttaaacctgtttgtaaaggttctgaaacagattgacgagccataacgccaggtgctttcttttcgataggacgtgttttgtctgttttaatttcgccgcgtccatccactggttgacccaaaggattaacaacacgaccgattaaagcatcgccaacaggtacttccatgatccgacctgtccgtttaacttggtccccttcacgaatattttcgtattcgccgaggatgatgataccaacatcatttgtttccaagttttgtgccacaccgtatgaaccgttagagaattctaacaattcacttgagagggcattttctaaaccgtgagcacgtgcgatcccatcaccaacataagtgacagtaccgacttcttcaacggctaattcttcattataatttgctagttgttgtttaattaatgcactgatttcctcagttttaatgctcatctatttcaataataacgacttaatttggtctaagccgtgtttgacacttccatcgattaccttatggttcgattcaagcacgataccaccaataatatctggatcaacgacactttcgattaacacttcgtttaaaccttcgcgtttagcgaaagattgactgatcttagctaattgatcatcgtctaaagcaactgctgaagtcaccttagcgtgtgcaatccccttatgttgatcgtaaagatcttcataagctgcgataatataaggcatttcagccattctttgatagtcaaaaactaagctcaaaaagtgttgcattaaagtactaaaatcattactcaacgattctaataagttacgctgtttcaacccagataaggttgtatctgttaaaactgtgcctaattttggattgtcattgaaaatggtctcgagtgcttgtatctcatcatggatactttcaaattgttgctcttgttctgcaagggaaaataaggcctttgcatagcgttgtccgactgcatacttatctagtttcatttatctagtttcattttgcttgtccaacccttcaatataggaattgatcaatgacttttgatcagtgactgacaattctttcttaatgagtttagaagcaatttcaatagataattgagcaacatcatctctcgcactgtttaacgcatctaaacgagattgttcgatgtcttttttagcattttgttttaaagtttggacttcttcttgagcgagggtaaccataccttcgcgttgtttttcaccgttttgtttagctgtgttaacaatctcaacggcttctgatttagagctcttcaactctgttgcacgttgtgcggccaatttggcagcatcttcgcgtgattgagcggcgctatctaaatcatttgtgattttatttgaacgttcctgcatcatttttgaaacaggtccgaaagcaaatttacccactaaagcgactaagatgatgaagacaacaagtacaaatagtgaatctccaaggtaagatgcagaagcaccaacgattaaattactaaacatttaactaaataagatcaagaaagaaacgacgattgataaaattggaacagcttcaattaaaccaacaccgataaacattgttgatcttaattgtgctgacaattctggttggcgtgccatactttcgattgtcttagaaattaccttaccattaccgtatgatgctgcgaatgctgcaagtcctgctgcgatagctgctgctaaaaagttcatttagtcttccatttcgactttctctgaaatgtagaccattgataatgttacaaatacaaaggcttgaattgatccgataaagacggagaagccttgccataccatttgaattggtgctgtgacaagcattgtggctgggccatgcgagaaagccatcttaactaaaagattcaataaaacttccccggcaaaaatgttcccatacaaacgcaatgacagcgtcaagaaattggtaaattgttcgatgatattaatcggtaagaaaaatcctactggtttaatataactcttcaaataattaccaaatcctagtcgttcaatactgaaataatgcgaaaggactaatacaatcatcgctaaggacattgtaataatcggatccgcagttggactcttcagccaaaccacttcgtccaccttcatctggaaaatcaaaccgaactgattactaatgaatacgaaaagaaacataacaaaggcaaataggtagaattgcttcccttcttcgcccggcatagcactcttaacgataccattagtaaaatcgatcatccattccaggacgttctgccgcttggttggtttcaacgcaatctttcttgataagaagaagacgagcgcgaaaacaattgctgcacttaataataccgaaaggcagttcgctaaattaaaacgaattcccaaaatgctaataatgggatatttatcacccacttatttagtcccgaataagcgatcaccggcatcgcccaaaccaggataaatgtagccttcttcattcaatccatcatctaaaccagctgcataaatatcaacatctggatgtgcttcttgcacagctttaacgccttcaggtgctgctactaaaacaactaaacgcattgatgttgcgccacgttttttaagggcatcaattgccataatagcagaaccaccagttgccaacattggatcaacgatgaataattgacgttggtcaatatctgttggtaatttaacgaaatattcgtgtggttgaagcgtcttttcatcacgatacattccgatatgaccgaccttagcagctggaatcaattctaaaacgccgtcgaccatgcctaaaccggcacgtaaaattgggacaactgctaattttttaccgctcagttgcttttcaatagctgggcccattggtgtttcaacttcaacgtcttccattgctagatcgcgcgtaatttcgtaaaccattaattcggcaatttcattcgccacttcacggaacactttagtccccgtattcttgttacgaataattgttaatttgtgttgaattaacggatgatttaaaactgtgaactttgccatttaatctaaaaactttgcttgtgtgattgggaattggtcggttaatttcaagaccgcttcactaattgctgtcatcgcttctagttgatcatgtttttcgatcacttctagaattaaattggcaatttgttcacaatccgtttctttaaagccacgcgatgtaatggccggtgtgccaattcgaatcccgcttgtcttaaacggacttaatttttcaaacggaattgtatttttattaaccgtaatatgcacgctatccaatagattttgcagttcttttccatttaggccactattggtcaagtccaatagcatcaaatggttgtccgtcccccccgaaacgacccggactaaatctgattggtcaaagacagctgccattgcttgcgcatttgcaacaatttgttttgtataagctgtaaattctggttggagcgcttcaccaaatgcaactgctttagcagcaatcacgtgttctagtggtccaccttgaatccctgggaaaatggcagagtcaattgccttagcatattctgctttgcaaagaatcatcccaccacgcgggccccgcaatgtcttatgagtggtcgttgtgacaacatcggcatatggcactggactcggatgaacacccgttgcgactaaaccggcaatatgggccatgtcaatcatcaaataggcaccaacctgatcggcaatttcacgtaaccgcggaaaatcaattgtgcgactataagctgaagcaccagcaacaatcatcttaggatgcacttcttgcgccttagcagctaagctagcataatccaattgttcgttggtatcagcaacgccatagctataaaagtcatagagttggccactaaagttgaacggtgacccatgcgttaaatggccgccatcagttagattcatccctagaatcttatcgccagattctaatagcgcttgataaaccgccatgttagcttgtgaaccagagtgaggttggacgttgacgtgatcggcaccaaataattctttagcccgttcaattgcaagtgtttcgatttgatcgatatactcgcaaccaccgtaaaaccgcttgttgggataaccttccgcatatttattcgttagcacactgccctgtgcctcttgaacagcacccgaaacaatattttcagacgcaattaattcaatattatgacgttgccgattttcttcttgcttaattaaatcattaatcactggatctgtcttagctaacatttaatcggcttgttgcttgctaaaatacttttgccctgctgatttttcgagacggttcatatacgctaaaccaacaccttccttggcaaagccttggacaaggattagtttaacttccggattcaaatcaaaataccgtagtccttcaaataaatgctggctcgctgtgacaaccgattcacctaatgagaattggtccttgaagcggacttttgcttgcttttccaaaatcgtatcgacggccatcacaccaaatgggacagcttgttggctagccccgtcaatcgcagcatcaaagtcatccggattagcgacaatataaacctgtgcgttaggcgcataatgcttatacttcatcccgggtgctttcggtgtttctgctgctccgactttgtgcttattggtcataattggaccaatgacgcgttcaatagcttcttgtgttaccacgcctggtcgtaaaataactggggttgcgacacttaagtcaataaccgttgattccaagccaacaccggtaggcccgtcatcaatgacgccggcaatcttccctgtcaaatcatgtaatacatgatcagcaagcgttggacttggtttcccagaagtattagctgatggaccaacgattggtaccccagcggctttaatcaatgacaatgtcacttgattgtctggcattctaaaagcagcggttttcaaaccacccgtcacaacggcatcaaatgccccatgcttcaagggcaagataatcgttaatgaaccaggccaaaaagctttgactaattgcctaaaagccgggtttgacgtcactgcgtaatgttcaaccgtttcaaccgaagcaacatggacaatcaatggattatcgctaggacgtcctttggcagcgtagaccttcttaacggctgctggattagtcgcatctgcccctaagccataaaccgtttcggttggaaaagaaactaattcgcccgcatttaaagcagcggctgcttgttcaatttggttgactgtgtatcgttttgtttccatctataataacaaattccgattaaaatcgtaactcacacgcatcattctagaccaatttgccatatccttttgtacttctaagctaaacagaggatctttttgttcaaaaatccgaacaatcgcttctttttgttgataaccgaactctaaaaagagtgcgccatctggttctaaaaatgcggggacttcctgcgcaaagcgttcataaaaggctaacccattattaggcgcgaataacgctaaatccggttcgtgcttaagtaccgaagcatccatgacagagcgttcgtcttctgcaatatatggcgggttcgaaacaatcacgtcaaattgttgccccataacaggcgtcaagaaatcaccttcgatgaagtcaacctttgcacctaatgtttgggcattttgttgagccacggcaattactgccggtgaaatatcaaccgcagccacttgccaatcagggcgttcacaggccaaggtaatcgcaatggcaccagaaccggtcccgacatctagcacttttagtggtctatccttaacaggggctactgacaatacccattctaccaattcctcggtctcaagtcgcggaataagcgttgcgggcgtcaccttaaaatcacgtccgtaaaaattggcataacctaaaatatattgtgccggttggtcctccgcaaatgccgccaaatcggcttgatattgttcatactcgtttgcgggcatttcatctctgtaatgcaatactaattgagtggtcgtccaatgatgacgtcctaataataggaaacgcgctgcttcacgttccttattgcgttcttctaaaaataaaaaagcccaattcagggctttaagataagtgagctgtgccatttaagataagtgagctgtgccatcttgtaattgctccaatttctctgtttgatcgaagaggattaaggcatcgattacgtcgcctaattcaccattcataatgcgatctaacttattgagcgtcaaaccaattcgatgatcagtcacacggttttgtggataattatacgttctgattcgttctgaacggtccccagaaccaacggctgatttacgacttgagtcatattcactctggttttgtgattcataataatcataaacacgtgcttgtaaaatcttcattgctttaacacggttttgttgttgtgaacgttgatcttgcattgcaacgacaatcccagttggaatatgggtcatccgaacagctgaagaggtcttattaatatgttgaccaccagcaccagaagcacggtaaacatcaacccgaatatcttttgcttctaattcgacatcaacaccatcgtattcaggcataacagcaacggttgctgttgacgtatgaacacggccttgtgattccgtctttgggatccgttgaacacggtgtgcaccattttcatattttagtttagaataaacattcttaccggtaatcatcatcgcaacttctttgaagccgccgacttcagtagccgtttcatcgatgatttctgtttgccagttttgtgattcagcgtaacgttggtacatgttgaggaggtcacccgcaaagagacttgcttcgtccccaccagcagcgccccgaatttccatgatgatatttttttcatcgttagggtcagttggtaacattaaaatcttaatttcttgttctaattgggctttttcagtttggagttcttctaaatcagccttaactaattctgtcatttcagaatcggttgtttctcgcaaaagttcttcattttcagtcacttcgcttaaaacttccttcaaacgcgtatacttgcccacaatttcgcgcaagcccgcttcttccttagaaagttccatgtagcgactggtttcattaatcacttctggatcagacattaattcctgtaattctgcatagcggtctaataaaccatcgagttgttcaaacattttatccatttagccttccttttcaatctcttcttgtattggtgggttaaaatagtgcttccggcatactggatagtaagcttcattgccaccgatttgaatctgttcacctgtataaacaggcaagccgttattcattcgcaagttcataatcgcctttttacggcagaaccaacaaatggtcttcatttcttctatcttattggcaaacaataagaggtatttcgagccttcaaataattcattcttaaaatcatttttaagaccaaacgccatcaccgggatattcaaatcatcaacgactttggcagcttcgataacatggtgccgttctaaaaattgtgattcatcaattaaaacacaagcggcatctggattagttgcttcaaccaattcgtaaatattcgtgtccgaaaaaattggtgttgcttcgcgtttcaaaccaattcgacttgaaacgattcccacgccgtcacgattatcaatcccactggttaagataatcactgatttattctgttcttcataattatgagcaacttttagaatttcaattgatttaccactgttcattgcaccatatcgaaaaaataattgcgccatatgacaattaaaagttcatttgcaacaacaacgggacgtttttcatactggttcttacatacctttatgaaaggcggcagctctttacctggtcagattgcaacaaatctagaccccgctgttttgaaaaacttaactaaaaactacgacgtgattatcatcactgggactaatggtaaaacgttgacgacggctttgacggttcaaacgctcaagcaaaaatacgacaacatcatgaccaattcaacaggatcaaacatgatgcaaggaattacgacggcctttttggcccatcatcctaaaaaaggtcaaaaacaacttgcaattcttgaagttgacgaagccaacgtcgaaccactttgccgctacgttgaacctaaggcaattgtgatgactaacatctttagagatcaaatggatcgttttggtgaaatttataccacttataataagattttggctggcgttaagctcgtgcctaatacaaccttaattatgaatggtgatgtgccacttttctcatcggttgaattacctaatcctaaaatttactacggttttaatcatcaaccagatggcgaaatgctcgcaccaagcaatacagacggcgttttgtgtcctgtttgccaacatatcattcactacaagttcatcagttatagtagccaaggcaaattctactgcccaaattgcggcttcaaacgccctgaactaacggatcaagtgacggccatcaacgaaatgcgcccaacaagttctcaatttgaaattaaccaagcaccttttgaaatctcaatcggtggtatgtacaacatctataatgctctcgcagcttacagcgttggccgcttcttggatgtccctgtttcggatattcaaaaagccttcacgcaaaataaaaaagttttcggtcgccaagaagtgattcaattgaaggacaaggcggtcacattggtgcttgttaaaaacccagttggcttaaaccaagtcctccaaatgattagctctgatccagaagatttctcattggcaatgttactgaacgctaactacgctgatggtattgatacaagttggatttgggacggtgaattcgaagacctcttgaaacaccacattccaacggttatcactggtggcgaacgtcgcgatgatatcactttccgcttgaaagtagctggcgttactgacgaacaactacacgaaacagccgacttagatgcgacattagcagcgattgaagcagcccctacgaaacatgtttacgtacttgctacctacacggcagtcttacaattacgtaaaaaaatggcagaggccaactacattaagaaaggactatcagtatgaatgacccaaactttaaaaatttgtcatctttatggcaacttaatgaatacttatggggatctcggcaatattttagtcctcgattattacgctaaaaagattggtttaaaaactgaaacagaagtcattagtatcggccaagatttcgatgctagccgctatgacatcgtcctcttcggtggtggccaagatttcgaacaaaaaatcatttcagaagatcttaacagtaaaaaagctgcactcacagcatacatcgaaaatggcggcgtaatgcttgccatttgtggtggttaccaattattgggccactactacatcggtgcgaacggtgataaaattcctgggattggtgcccttgatcactatacactcagccaagataacagccgttttattggcgatatcgtgattgaaaatcgtgaatttaacgaaacttacctcggctttgaaaatcataacggtcggactttcttaggaaaagatgaaaaaccacttggttatgttaaccgtggtcatggtaacaatggcgaagatggtactgaaggttgtgtttataaaaacacctttggttcttacttccacggcccaatcttaacccataacggtgtcttagctaaacgcctcttaacaacagcgattagccgccgtttcccagagtttgatcttcaaccactagcggaccttccaatcgaagaatcccgctaccaagtcgacgcagctggtgtcaaaaaggtgcaaaattaattaatctaccaatgttaattgactttgagctgctgccaaacgcgcacttggcacacggtatggtgaacacgagacataatcaatgcccaaatcacgataaaacggcatcgctgctggatcaccaccgacctcgccgcaaacgccaatcgataaatcaggtttggtttgacggcctttttgaaccgccaattgcatcaaagcaccgacaccatcttggtcaagcgtttgaaagggttcagccggcatcaagccttgttgctgataatccggcataaaatggccaatatcatcgcgggaaaaaccatacgtcatttgcgttaaatcattggtgccaaaactgaagaaatctgcggtcgctgcgatttgatccgcaactaaacacgcccgcggaatctcaatcattgtgccaatttgataagttagttgttgctgattttctaccaaatagtcgttgatggtttgctgtaatagttgctttagatatgccatttcagtcgctgtgccaattagaggcaacattattttaggagctacagcatggtggtgcgttgtttgaaccgccaaggcactctcagcaatcgctaagacttgcatttggtaaatttcaggataggtcaccgccaaacgactgccacgatggcctaacataggattaatttccgctttgtcagcaatccgtcgcttaatttcagccagactaatgcctagcgcggttgctaattcagcctgttccgcttcattttgcggtaagaattcatgcaatggtgggtctaacaagcgaattgtacatggtcgctcttcagctaatgaaaagatttgcttaaagtcagttatttggaggctttttagtgccgccaacgccacttggcgatccgctaattcagttgctaaaatcatttggcgcattttaaaaattcgttctgggccaaagaacatgtgctccgtccgtacaagtcctaacccctgtgcgccaaattcaaaagcagccgccacttcttgaggtgtctcagcattggcccaaaccgcaaagggtgcaatctcatcacaccaactgagcaccgttgtaagcgttgtttcatgaacaccggtttgttggggcaacgcccctaaataaaggtgaccggtatgaccatccaccgaaataatcgccccttcttttaaaactcggccggcaaaatgcgcctcacgttgttcataatccacttgaagctgctgacaaccaacgacacaacaacagcccattcctcgggcaacaactgccgcatgcgatgtcatcccaccacgactagtaacaattgcttcactgattaccatcccatcaatatcttctggtgacgtttcttggcgaactaaaatgactttttcaccagcttcgtgtgcctgttgtgctttttgggcgtcgaaatagatcgcaccagtagcagcccctggactcgctggtaacccagtcaataactgtgttgcctgttgcaccgcactagtttcaaaaagtgggtgtaacaacccatcaatcatcgtcggcttcaagcgactaatcgcggttggccgatcaatcaccccttcatcaactaaatccacagcaattctaaaagcagccggtgcggtgcgtttgccaacccgtgtttgtaagacatataactgcccagcttcaatcgtaaattccatatcttgcatatcccgatagtgggcttctaattgattggcaatcattttgaattgttcataaattactggcaattgcgcctttaacgtcgcaattggttcgggggttcgaatccccgccaccacatcttcaccttgtgcattcaataaatattcgccaaacaaaccaggttcaccagttgctgggttccgagtgaacgcaacgccggttccactttgcccctgataattaccaaagaccatttgttgcacgttgactgcggttcccatggcaccgtcgatttgatttaaacgtcgataagtctgcgcacgtggattctgccatgatttaaagacagcttcaatggccagtcgcagttgttgatcaaccgactgtggaaattgatattgtccggccgctacgtacaagcctttataggtttcaatcaattgttttaaatcaactaacgttaagtctgtatccttttgaacttgccgtttatttttaagcgccgttaatgccgcttcaaaaattggcttatcaataccgtaaaccacatccccaaacatttgaatcaaccgacgataacaatcgtaagcaaaccatggatcattggtcatttcagctaagccgattaccgtttgatcgtttaaccctaaattcaagatagtatccatcatccccggcattgagattggtgcaccactgcggacggacaccaataacggctgctcagcattccctaattgccgctgcgtcttttcttcaagaatatgaatcgctttcattaattcgtcttctaaaaagcccgcctcttgtttagcacttgctaagtattgtcgacaagcagccgttgtaattgtaaaaccggctggcacgggtaatcctaatcgcgtcatttccgctaagttggctcccttaccacctaattcttgattggttaacgtttgatcttcagcaaaagcataaatacagttcatatggaattatctaaccgtcaacaggaaattatcaaaatcgtcaaagcgaatcaacccattagcggcactaaaattgctgatcaattacacctttctcgggcaacactgcgcaatgatttcgcaattttaacgatgaccggcattttggacgcccgccctaaagttggctacttttacgttggccaagaagtgatgccgctcttaaccgatgaactctaccaagaaacagtcggtcaactgatggtcccacctcttttaatccctcaaacgacaacgattgatgaagcggtcacgcaactattcatgcacgatgttgggtcgctttatgtaacggatgagcagtcaggtttgctaggtgttttatcacgaaaagacttactgcgggcaaccattaatacaactaatacacaaactacgcctgttgccatgattatgacgcgaatgccaaacattacaacgaccaccgaggaaacatctgtcttacacgccggtcaacggttaatcgcccatcaggttgattcattgccagtggttgcaatcgacggtatcaccgtcattggcaaaatcaccaaatcaattattatgcgctatttcatcgaagccggactacacaatcaatcataaatgtcagcgattccaatttttatcatctcagattcaattggcgaaactgctcgaacagttatcgcagcggttaacgcgcaattccccgcttcagtcacccttaaaattcaacgctttccgtttattaccgatcaaaaaacattaacccctattttgcaagatgcccatcaagaacaggcaattattgtcacaacacttgttaaccacacgcttcaagaaacggtgacgcaattttgccaagccaagcatttaaccttaatcgaccttctgtcttcgctgaccaccgccattagcgaacgcagtcaaaccgcatcgctggaaaccccaggctcattacggaaacttgatgaacactatttccatcgcattagcgccatggaatttgccgttcgttacgatgacggtcaagatccacgtggtttattagaagccgacatcgttctattaggtgtttcgcggacctcaaaaacgccactcagtatgtatttggccaaccaaaactatcgcgtggccaacttaccactcattcccaacgtgccattaccaaaagaattattcaaagtgcccgcccataagattatcggtctaaccatgccactttcaacactgctaaaaatccgccaagaacgtttggccaccttgggattaccgcaaacaacgaactattccaatatgacaaccgtcggtgacgagcttgcctatgccaaccagatttttgaacaattaaacgccacgacgattaacgttgctggtcgctcgattgaggaaacggctagtttaatccaaaccttaatctaaatgctaataaaaagccaaaacattgaatccgttaaaattaaaagtattgatagtcaagataaggtcctcgcgacaaccgagtccggcgaaattatcgaactacatatcaccgatcaacaaaagaaggatcggcttttctgggaatcattggtgaacgttttacgcgctgaactctggctccccctcaaaaagaaaacccatgaactcttacaaaacgactggttagcagaaccagaattaaattaattattttgcaccttgccattccgcaatgtactcggccacaaaatcttgcatgacttgtgttctagcggttgcgatttctcgcgccacttgcgtattcatcgtcgccgcgagtttgaagagcttttcataaaaatgattaatcaccgttgaaggttcccgataattagccttggttaactcggcccgtggttgaatttcaggatcataagccaccccatcgtgagcgccgccatacataaaggtccggccaataccaatcgcgccaatcgcatccaaccgatccgcatcttgaacgatttgcccttctaaacttaatgtctggtgctgattaatatttttagaaaatgacatatgatcgatgatgtcaaaaatcgtggttgattgcatcttatcaatgccattttgggttaaaacagccgctacgctttggcgggcttgtgccacatcgctaacaattttttcatcaatcacgtcgtgcaatagtgcggctaatgtaatcgttgttaagtcgccatcaccaacttggcgttgaattaagcgggcattattgacaacccgttgaatgtgatcaaaaccatggccactatgctcctgagctaacgctgttcgtacgaattgttcaattgcttcaatttgtttttgcatttacttgttacccggttctgaagcaataatttgcatgttaccttttaagtcccatgacttaatgccaaatggtaagacaaagtgcatattcttatgaattgggtaggtttgaccatccgcaaccagttcaccttcaccgtcaaccactgataataaagtataaggggctgttgtccgatcaaagtgtaaatcacccttgaccaaccattggtaaacactgaaaaatggtgacattgggggttgcacataagttgtgatggttgaatccccaacgtgttctgtttgaatattcaaaacaggatcttgatggggaacaatcgtggtatcaattgattgttttagatgcaattcacgtttttcacccgtcttcgcatctactcgatcataatcgtataaccgataagtcgtatcactactttgttgcgtttcaagggccataatccccttattcaaggcatgaattgtgccacttgggacgtagaaaaagtcgcctgttttaacaggtactttgcgcaataagtcatcccacttacccgcttcaatcatttccgttagttctgctttgtttttagcatgatgaccatagattaagtaagcacctggttcggcatctaaaatataccaacattcagtcttacctaattctgtaggaccttcatgagcagctgcataggcatcatctggatggacttgaactgataagcttgcttcggcatccaaaatcttcgttaataatgggaaaacttcccctttggcatcgccaaagtaatcgcggtgttgagtccaagcttgatctaatgtgaggccttttaagggaccattttcgattgtgctgggaccatgtggatgtgctgaaatcgcccagcattcaccaatgtcaccatctggtaaatcatagtcgaaggcttctgctaatttgcggccaccccaaattttttcttggaaaactggttttagaaataatggttctgtcaattagcccttatcttcagccaagaattgatccacaatcattgtccgacgatcaagaaaagtttgattatctgctgtcgggtgaatccgattgctcaacactaccaagcctgtctggcgttttcgatcgagtaacataaatgtccctgtaaaaccggtatgataaatcaatggtgtctgatctgccgtaaaacgtaaatcccaacccaatgaccggcctagatgggctggtgtccagtcgcggtataagcccttaacacttgcttgactaacaggtgcctcagcaacctttaattgccctagttggaactgcgcaaaccgcacaacatcgtctaggggtgcaaataatcctgctgcaccactatgattttgcaaaacataactcttcgggtcatgcacaacaccttgaataaggcctctagtcgttgttagttcggtgggtactgctcggcttgcttctggggcaaacgtactctcggtcatccctaagggggttaaaaccagactttgaattaagtcttgaattggtttgccataaatcacttctagcatccagcccaaatacaacatgccgatatccgtgtagacgaccttttccccaaaattaggcccaaccgtcaattgcgtcaacagcgcttcttttaatgctggcgcagctaactgattacgattaggaatatagccctctaagcccgatgtgtgagtcaagaggtgcaaaaccgtcacccgtcgatctttaaacgctggtaaaatactatgaaccttggtcgtaagtgacaagcgtcctcgctctaacaaacggagaatcaacgtcgtcgtcccaatcaccttcgtcaaagacgctaaatcgtataattgtcctggttctaacgggattagtttaggcgtcagttctgaataaccaaggaccttcgtcgtcacttgctggccttcaatcacggcatatgaaacacctggtacaacctcatcagccactaacgcctcaatttggtgaatcgtttgttcaaatcgcatttaaatctcgacgttccctgagaattggctgttatatagatcagcgtaaaagccgtcttgaaccatcaattcatcatgtgtgccggtttccataattgaaccgtgattcatcacaatgatattatccgcatcccgaatcgttgataaacgatgggcaacaacgaaactcgttcgattttgcaatagacgttccattgcgtgttggatatgaatttcagtccgcgtatcaacagaactggttgcttcatccaagattaagatatctggatcggccacaaaggcccgggcaatcgtcaataattgccgttgaccttgtgaaatatttgaagcttcttcattcaagactgtgttataaccttcaggtaattgacgaacaaagccatcaacatgggctgctttagcagctgccaaaatcgcttcgtctgaagctgattcattaccgtacttcaagttatcccaaatcgtcccggtgaatagccaagtatcttgaagaaccatcgcaaaatgactccgcaattcttcccgactcatatcacgtgtatcgacaccttttaatttaatcgaaccgccactaacatcgtagaaacgttcaagtaaattaataatagttgtcttaccagccccggtaggaccaacaatcgcgatcatttggcccggtttaacttgtaaattatagtccgtcaacaagagatccttgccttggtaaccaaattcaacatgttccatttctaattggttggcatcatcttgcacaactgggacagttgaaggttcttcagacatatcttcttcatctaaaacagcaaaaacccgttcagctgaagcaatcgttgattgaattgtgtttgccaagttagccaattgtgagattggttgtgagaattgttgtgtatattgcatgaaagcctgcatgtcccctaatgtgacttgaccgtgtgagacgcgaatcccaccgataatcgcaacgaagacgtaccctaagttattgacgaaagtcatcaatggcatgatcaccccagagataaattgggctttccaagcagctttatacaacttttcattttgttcttcaaacgtatcaatcgtcacttgttcccggttaaaggtcttcaagaccacttgaccggaaaagttttcttcgatttgattatttaataagcctaaactcttttgttgtgcagcaaagaatttttgcgacttaggtgcgacaatcccaacgacaattaaactcaacggaattgtgaccaaagcaatcagcgttaattgccaactgatcgtcagcatcatccataaaacaccgataaacgttaccgtgctggtcaccatttgcgttaaactttgttgtagcgtgctggcaatattatccatatcattaatcgcacgactcatgatatccccgtttgaatgggtatcgtaataattgattggcactcgttgcatcttatctttcaattccttacgcaattcatagacggtttgttgtgaaatccgcgtcataataaattgttgtaagaaactgaagacggctgaagcaagatacatcaagatcaccgtcatgataatgtgttgaatcttatcgaaatcaattggtaagcgatccattgcaatcccagctttttgcatggcattgcctttcatcacccctttaaagatttcagttgttgcttcccctaaaactttgggcgttctaatctggaaaataacggagacaatcgccaaaacaatgacaaatactaaggcaattaaacggctcgacatgtatttcaataaacgattagttgtgccccagaaattcttaggcttttcaacgacgccacccatgccgcgacctggaccgtgaccaccttgtggccggtttgttgctgctttttctgccatttaggcttcatccccctctctgatttgtgaattgataatttcttggtaagttgcatttgttgcctttaattgggcatgcgtgcctttaccaaccatttggccttcatctaagaccaagattgtatcggcatcagccacagttgagacccgttgtccaacaatgacgacgacactcttttgaatttcagtatcttccttcaaggctttgcgtaaaagggcatccgtcttgaaatctaaagctgaaaatgaatcatcaaaaacataaactgatgcgcgtttaactaatgcccgggcaatcgctaatcgttgacgttgaccacctgagaagttaccgccaccttgttcaacgtgactgtctaagccaccatcaagttcgctaacgaaatccttcgattgggcaatttcaagtgcatgccaaatctgatcatcagttgcatccggattcccatattgcatattttcgcgaatcgtccctgtaaagagattggctttttgcggtacaaatgcgacttgttcatgaatatcatgcaatgtcacatctttgacatttaacccatcaacttggacttggccggcttcaacgtcgtaaaaacgcggaatcaagttaaccaaggttgatttacctgaaccagtccccccgataatcgcaacggtttgaccagcagatgcttggaaatcaatcttctctaaggctaatttttctgcattttggtagcggaagttaacattatcgaaggccaagctgacagtttgatctgtaaaactcttgggattttctggattttcaattggtgtttgtaaatccaagacttcattaatccgaacggctgatgcttgtgcccgtggaatgaagacgaaaaccattgaaagcatcatgaaactcattaagatttgcatcgcataagtcatgaaggctaataagttccccacttgcatggcttgatcagcaattaagtgaccacccatccaagtgattgcaatgtttgtcccactcataatcaatgtcatcacaggtaacatgacagacatgatactgtagacctttttagcattttgtgtgtaatctaagttcgcatcgtcaaaacgttcctgttcgaacttatcgcgacggaatgcacggattacccgcacccctgttaagccttcacggaaaactaagttaatccggtcagtcttcttttgcatcgctttgaaaagtggcacggcaaagtacatcacgacaccgataaagattgccatcaatggtaagacaacgacgaagattgatgttaattgcgcgttcttttggtaagccaagaagctggcaccaatcaacataataggggccatgatcatcattcgtaagaacatcattgccacattttgaatttgaacaacatcattggtcgtccgtgtaatcagtgaagaggtccccacttggtccatttcatcgtgtgagaaattgatgacctttcgataaatatctgatcgtaatttttgccccagaccttgtgatgtcttagcagctaaataaacgttacagattgcggctaggatactgatcaatgaaaaaccgagcattttaaagccggcttgccagatataatcaatatctcctttggcaatcccgttattgacaatatcagacgtcaaattagggagatacaagttactgacaacttgaatcaccatgaataagacagcaccgaaaacggctaagcccgacattctcttttttgcaagtttaatcatctacttatcttgaacgctcgcgccggtttctaaccaaccagtgactaattcgaagtgttcgtagatttgttctattgttaaggcttgctcagtatcacgatttaaataataggaagcaatactttgaaaaacgttattcattaattgatggaggagcaatctaacagcattcggctgcgttttatcaattttcaacaaactaaaatcaacatgatccattaaaaactgaaagccctccgtttgatgtgcatgcatcaattcgggcgacatcttgcgccgatttttgaaatccatgtgtaaaaataagtgccgatagaactgtgcattctcaccattaatggcttcattcgccattgccttgaagaaaatgcgaatcgtcttgaaaagatcacccttggtatctaataagagctgttctaaatcctgtttagaactatcacgcagcaaactgaggtcgtaaaagaaaatatcagccttatcttcaaagtactgatagaaactaccccgtggaatttcagcagctttaataatgttgctaactgatgcttcattaaaaggaacccgtgaaaattcggcatgggcggcctttaataaccgttgctgtttttctgccggcaaccgaaaaaaagtttttttaggcatatgaagttactcaaacgtttttacaccgttaccatcgccgtactcgccatcatctcaattatcttcgtcctattagactacagcagtgtcatcgatctaacgactgcaccctacctaaccatcgataacacgattttaattatttttacggtcgattatttcgtgcgtctttggtttgctactgataaacgccgcttttttaagacaaatatctttgatctgcttgcaatcatcccactaagcactcttttttcattttttcgactcgggcgcctatttcgcattgctgggttaatgaaagttttccgttttacgcgcttggtgggcttaacggggaaattacaacgccattccaagaaatttcttaagcaaaatggtctgctctatctgacttatgtcagtgccgccgtattaatcatcgcttccgttttatacgcactcgccgaaaaggcaacccttgctgattcattctggtgggcgattgcgaccgccacaacggttggctacggtgatatctcaccgcacacgctaatcggtcgtatcgcagcaattatgctgatgtcagttggcattggctttatcggcacactcaccagttcgattaccagttacttcactcaagataccgacgataaactagacgaaatccttaagaagctcgatcatctcgaacaagaaaacaaaacgctcaaggcactttatcacgacaatgaatctgaatcaaaataattaaagtttaacgatgtttgttgcttgaggaccgcggtcgctgtcttcaacatcaaatgatactgcttggccttcgtctaatgacttgtaaccgtcaccttggatagctgagaaatgagcaaatacgtctttgccatcttcaccagtaataaaaccaaaacccttgtctgcgttaaaccattttactgtaccgttgttcatatggaggtggcgcgtattaaacatttcaaacacattatctgttttatcttgcttttaatcatgcaacaaatcccccttttattagtaggtagcctagctgccctaccaaaggcacagcggacagcgcatttaattttaaccgttgggtggctctttttaattctaactattgggatcaccattttaatgtggtatctttaccaaaaagtaaaagggccgcaatatcataaccatttttcaaaagcccactggcgcccaattttaattggatttgtcgccatgctagtgattaataatttgacggtgccctttatgcagaaaacagggaacgccaatgtcgatggcctcgttcaaatttttgccgtccttggcattttcatgttgccctatactttaattttaggaccaatgatggaagaattacttttccgtggtttcttaatgaattggttcttcgttaaatcacccattctaaacattatgacgagcgccctattattcggcctcgtacacgtttcaactgatccgatctatttcatttccaaagcactactcggattagtcctagcaatcgtttattatcgtacaaaaaccattaagagtagtatcatattacatgtcttaaacaatctctcagcagggctaactattttttaaatgtctactttaacgactattttaacctatatccaagaaaatcctgaaacagtgactttagaaccattccaatatgctaacgttatccgttttggcatcgatgaccaggtgcaactaccagaaatcgaaaaactattcccagatatgcggctccacgttaaccgcatcgattcagactacgttaatgctcatcgtgacttattagaagccttttatcaacaaaccatagagaaacaaaaagacggctttcaagatgtctggattacaaccacccatctttccgaccgtcatattttcctagtggatctttcttttgaataattaacggctcattttcttcgtttcagcaatcacttcttctgtgaagtataactgtaacgcgaagaagattgccagcagtgctgcggctaaccaagctgcgcggacgttaatcactttgactaagaaacctgaaccaattgtcccgataaagaagctaccaacaattagcccgaaatacttggctttttgttggtattttttttccttcgtcgcaataaataaataacaattttcaaccaacttccggtaatttccggtcgtaaaagtattggcatatggataaccattaaccgttgaataactggctagttgggttgccatcgacatcgataacatcgtcgtaacaatcatattagggacagcggtacttaaaaacccaacaataattaaaacgatgatttgcaatgcaagtaaccataaacgccaaatattcaagcgtgccgtgttaaagtggcgccgagccaattgcacaataatcacgccaattccaaaagcgatgattggcataatcttttcaggtaattgcgaccactgattagtggcgatatcaacaccgataaacacaatattacccgtttgcgcactagcaaacacaccacctcgtagaatcacacagtaagcatctaaaaaaccaccaataaaggttaaaaacatggctgttcctaaccggtcatgaaaattaattttcttttgcaattatagattgattggattagaatcttgatcatgaacaacttctcggaaagccatcagaccttgatcaaggccccgtaatagcacttccgcagtcccaatattagtagcaagtggcacttcgtaaacgtcagacaaccgaatgagcgcattaacatccggttcgtgtggttgggccgtcaatggatctcgtaagaaaataacgaggtccattttattttcagaaattaaagcgccgatttgttgatcgccacccaatgggccagacttgaagcgtttaacggataaacccgttgcatcaataattttctggccggttgtccccgtcgcaaaaagttcatgttgggccaaaataggctggtaagctgttgctaatttgacgattaatggtttttgacgatcgtgtgcaattaatgcaattttcatctaatgtcttctatgtttaaccactgtgaaaaagcggagtacgcttgccagtaagataaagaaaatcaatacaaacgagacgtaattcgcccaaaactgggttactggtaacacaatattaacgagctgttgtaataacatagtaatcaacgtggcacaggcaaccatgccaaataactgtccataacgtttcacggtatcatccgtcctttttgctttatgatgaaggccagcgccgattcgctgacactcagtgcgttttttcatagataatgtctttaatccaaatgagctagtttgaacaacttctcgaatcttcagcagtccggctgcactaagcaccttatcaaaagttctaaaagtcccatcagtcataccggtcacaaactcttctagcccgcttgcatagcaactactgatagtcacgtaactttttcctttaaaacgatctggcaaagcgtctcctacgtgattaaagcgtactaggcggcctcgcatacaatctaagaagtttttcataacaccagacatcgcgccccaataagtaggcgcaactaatacccacacatcagctgctaacaattgttgttcaagttgatctaacaccggatttggttgccccgtgtccggtaaaatttggaaatcgtttagaaaaatagttgagacatcatcttcgggacccacacctgctaaaacggcttgtaatagctggccattaacgccatcgcgttggtgactacctaatatacctaatactttcatttaataccaaccgtttgctaaccagaagctctttgcgccttcccatgaaccataacggcttgttacatattgatctgcaacacgttcttggttacttgctgagtagtcaccatttaagtatgagcttgataattggtaacgaccaacgaattgaccgttacttgctgagtatgaaccacctgattctttgttggcaatccattctttagctgagttagttgttgatgttgttgtgtttgtagttgtcgtagtagttgttgtttgttgttgtttaacaactggcgttgttgttgcttgttgttgaacgggttgtgtttgtgttgctgctttttgaacaggttgttgtgtagcaacaggtgttgttgtcgcttgagttgtttgttgtgttgccactggtgttgttgtagctgcttgtgttgtagcaggtgctaccgtaacagtttgtgtttcttcgtcgattgttaatgtttcgccaacatagattaagttcttgttagcaattttattagcgttagcgattttttcgatcaagctgccgttaccagcaaatttttgtgagattgatgataatgtatcaccgctgacaaccgtgtagttcgtagctgcatcggcatggccgttacttgcgaataaaagacctgcagttgcggcagttgataatgtagcgctgaataaaagtgttttaagtgatttcatctagacaaaaatcttatagttccggtggttaatagtaatcgattcctttgtgactttacgattagttttacgcttgagattctgcagaatattcaatgcatagtcacgatgctgttcaattaaggccaacacatcattttcaatcgataactccaatagtttacgtgaatcttgtaattgaatatgaacttggttctgatcttgggaaatcacctttccctgaaacaacttttcaacatctactttattcattcattttattctcttaattgcgtaaatttcttctatataaatagcttttttgttaaccactatctgattggccacccaaccagtaattcgacccgttatcggtgccaaaatctgaccgtcccggttgcgctgtgctaggtccaccgtgaccatcgtctttttaataatcgcctcgttgattacctcactagtctgtttagcagacatcttagcaagatgtgttcggtgcaactgcacgtcagcgatgctcgcttccttggcacgtaccgatgtatgatcacttagataaaacccctgccacttcatcatgccccgatcatgataatcatgcttcagaaattgcgtcactagtttgttatcaaaacgtttagtcatttagtcataagcattgccgcccgcatgaccaccaacaagtccggcccgttcaatcgcggttgcacccttatccttacttgataatttaaccaaagacgaaaaaccaaacttctgtcgaatttcgtcaactgtttgatctaattgatgttgctttaaatgacgcaattgcggatcgaataaatccaactgttgtacatcatcgtcaatcaattggccacaagtcagactaatatggcgaatggtctgatgttgccactgctctcgaaataattgaatcgctgttgtggtaatttcatgattaccattagtcggttcaattttcaatgatcgtccaaatcctgaatggacaccactttcattttcagaaaaagaaaagccaatccccaaactaatcatacacgcctgtttacgatgcgcacgtaaccgcgcagcaacctgttcagcgatttctctgataaccacttcaatttccgtttgtaaaaaataatcacgtggtagtacctgactattcccataggagcgctctttgggcgtgtgtttttgatggacaattgcgcgatcaatcccccagctaaacgcaaataattggctgccaataatccccatcttttgttttaaatcatatggattagtatgcgctaagtcccccatcgaatgaatctgtaattgatttaacttcgtcgccgtccgctgacctattgaccagacacgcgctaaatccgttacgggccacagcttatcaggcacatcttcatagtgccactccgcaattaaactgtgattatgtttagcttccaagtccaaagcgagtttggcaagtagcggattatcgcctatgccgactgtcaaataaatccccgtttcttttttcaccgtcagttgaatctggcgtgctacttcataaggcgtttgaccaaaaagatgccaactcgtcgttatatctaacaatgattcatcaatcgaatacggttggatgtcttcttctgccgtgaatctttgaaaaatacgattaatttttaaattttcttctatataaaggttcatccgtggttccgcaacaatcagccgtttatcatggaccggtacttgagtcgctcgggtcacattactgataccaaaaagttgtttagctcgtggactagctgccagcactaagccactgccagcgtttttggcagttgacatcaccaccaaaatcgattttaacggatttagccctctcttaactgattctacagaagcgtaaaatgatttggaatcaatcatcaatataattcgtcgcggttcatcagtataatcatacatttactcactcaccgcatttctaacgtagtacttatcaatcacgagttggcttctacgattatagtgtccaaaaacggcaatgtgcgcattctgctccgcgacatacattaaattaaaagtatccttggcgaccaagcaattataattttgagtggttgtttgtaatggaaactgaactaagtacggatcaaacgaaataacttttattgtactgccaatcgttccttgaagactaacgtactgcatttatacaatgcccttggttaaagtttggatctgttgcacttgctggtctaattgactttgccagcgatttatttcaattaaagtgacttgtggtaaatgttgtccaataaattgcggaaatttactacgattgtagtaatagttcatggcatctcgtaaatcgcttgattggcctgcttgttgtcgcaactctaagacgccaaaaccatttaaatataaacttaaattctgttgttgcaaatcaattatgactcgacttgtttgcatttaataccaaccgtttgctaaccagaagctctttgcgccttcccatgaaccataacggcttgttacatattggtctgcaacacgttcttggttacttgctgagtagtcaccatttaagtatgagcttgataattggtaacgaccaacgaattgaccgttacttgctgagtatgaaccacctgattctttgttggcaatccattctttagctgagttagttgttgtgtttgtagttgtcgtagtagttgttgtttgttgttgtttaacaactggcgttgttgttgtttgttgttgaacgggttgtgtttgtgttgctgctttttgaacaggttgttgtgtagcaacaggtgttgttgtcgcttgtgttgtttgttgcgttgccactggtgttgttgtagctgcttgtgttgtagcaggtgctaccgtaacagtttgtgtttcttcgtcgattgttaatgtttcgccaacatagattaagttcttgttagcaattttattagcgttagcgattttttcgatcaagctgccgttaccagcaaatttttgtgagattgatgataatgtatcaccgctgacaaccgtgtagttcgtagctgcatcggcatggccgttacttgcgaataaaagacctgcagttgcggcagttgataatgtagcgctgaataaaagtgttttaagtgatttcatttaagattcttcttgtcgacgcttcaaatggtacttattaattgctttttggcgtcctaaaactaacggaattcgttcgacaaagacatcactatattctaatccaaaccaagatgctggtgtatctgtaaacttctctaaccataaacgaatttgaacaatgactttgtccattgctctaatttgtgtttcaggtgataagtcctcttgaatgatcacaaacgagaagtcaccaacttctcgattaggaattgtcgtgtaatgttgtggttgtgctggtaattcaccattatgaatcatttcatggatgatttggcgaataaagatatttactttttgttccatcttaaagcctaaatacaattggacactgacaatgtaatccgtacctaatgtatcaaccgtgtactctgcagtgtaaggctcatccgtcacattcacagcaacaaaccaataaacctgagcacgcttaggccgtttatccaatattgaatagaggatattctttttcaccatattcttgccccggggttctgcctgaggttttgaaagataaactaagtttgttgtatacaatggtaatgacgtttcattccgtaggtcatgtagttggcgtttatacgctaatagtgacactgtacttgatttaaaggtattactttccttaatcgaattacttcgataccaaacaaacatgatgaataaaatgacaaaggcgattaaaactgtcacataaccaccatgcataaatttagcggcacttgcgataaagaagatcgtttcaattgcgccaaagaatagtaatacgacataagccaagagccaccgcttctcgcgccgtcccaaataatggaacaagagaatcgtcgtcattaacattgtaatcgtaattgctaaaccgtaggctgcttccatatgagctgagttcttaaaatagaaaacaaccgctaaacaaactgcccataagatccagttcacaattgaaatatagagttgcccttttaatttagcgggataatcaactttaatccgtggcaataaccgtaacttaatcgcttcagaaactaacgtatatgaccctgaaattagagcttgtgacgcaataattgcggccactgtcgctaaaagaatcgctggaattttcaattgtgccggcatcgcttcaaagaatgggttgaaatctgtcatattctgataagcggcaacttctttgtgctgtaataaccaaacaccctgtccaaaataattaaggaccaaacaagcggcaatataaggccagctaccatagatattatgccggccaacgtgacccatgtcagaatagagcgcttcggcaccagtggttgccaagaagacactacctaatattaaaatcccaaccttattttcaggactaaataggagatgaattgcgtagtaaggattcaatgctttaagcattgttaaatcccccattaaattcataacgccaatcgcaccaataaatgtaaaccaaatcaacataattggcccgaatgatttaccaatcaaatcggttccgaacttctgaataaaaaagagtactgataaaattgtgacagttaaaataatcacttcacgttggttggaaaccaaaacattgccattaatcggcaatcccttcagtccttcaatcgcagttgtgaccgtcacagctggcgtcaacatcccgtcagctaataacgtcgccccgccaataatcgctggtatcacgagccacttagcttgtttacggattaacgtatacaatgcaaaaataccaccttcaccgttgttatcggcgcgcagcgcgattaatacatatttaaccgttgtcattaacatcaatgtccagaaaacaagtgagatgctccccaccacaaaatcctgactaatattacgaataccgccattgccctcgacaatggacttcatcacgtacaatggtgatgtcccaatatcgccatagacaacgcccatcgtaattaacatgccagcgattgacaatttttgccgggttgttttcttttctgttgccaatttcatatgaaagataaagatcaaaagaaactcgaaatcgctaagaaacagtataaaaagctagctaatcgcccccttgctaaggaacgtaaaaaagcagttgggacatcttctatttatctgtttgtcgttgttgcggtaattttaattgcgctagccatttttcttaaacagcgttaaatgtctaccaacaaaaaaatctatctcgcaggtcctttttttagtcctgaacaaatcgaaagactcgacaaggttgcggccctcctagcgcaaaatccaacagttgagaccgaaagtattttccgccccaatcaacatagctattcagaagctgaatttggtagttttgaatggcaaaccgctactttcggatttgatattcgccaaattgatcaagctgatctcgttgtagcagtattagactatcaaacagaatcaggtcaatttgaacccgactcaggaacgatgtgggaatgcggttatgcttttgcccataacaaacccgttgttttagcacgttataaagatgatttaccgattaacttaatgttatccggtagtgcgacagctgtcttcaacggcgatgcagatcttactaatctagcaacttacgactttaacgcgcttcaaactaaatacgttgcaactaaaatttattaattagaacccattattttccgttaattgacgataccaatgaccacttttcttcatagtccgttgtgcattatgctccagatcaacccagaagaaaccatagcgatttctaaacccgtttaaccaagaccaacaatcattaaacgtccaagtatggtagccaaagcaactactaccatctgcaatcgctttgtgtaattggcgtaaatgttcctgcataaattcaatccgatagtcatcttgaatctcaccgtctgcagccataaaccgttcttcatctgcgacacccatgccgttttcagaaacataccatggaatattctgatagtcgttcttcatcatcatcgcaacatcatacaaggcttctggatagatttcccagccacgatatggattaattcgccgttctggccagacgtaattctcatagaggtcatcggtcgtcaacgccgggaagtgtggattggttggtgcctgtactcgcaatggttggtaataattaacaccaatgaaatcaacacggttagccgctaataaatctcggtcaccgacttcagtaacaggcgtcaattggtgttccgccaacaacgttatcaaagcaggtggcacctggcctaaaactgttggttctaagaaactcttagccaaaagtaaatccgctttttctttagctgccaagtctgctggcgcatcactcttcgcataagctggtgtaatattgagaataattccaatttgaccgtctggttttacttttctaaattcagcaaccgccgcagcgtgcgccaacaaagtatggtagcctacttgaactgccttcttgaaatcaatgatgtctggataatggtaacccgttaaataaccacattcaatatgaacgattggttcattaaaagtcgtccaacggtccaccaaatcaccaaataattcaaatgccgttttggcatatcgcgcaaaggccgttactgattctcggttttcccatccgcccttttccattaaccaccaaggcatgtcaaaatggaataaattgatgattggtgtaatattagcagccttcaaacgtttaaaataatctcggtaaaacgcgaccgcttccggattaacatgttccccgtctggcattaggcgggtccaagcaattgaggtcctgaatgaattcaaaccaatcttttgcatattttgaacgtcttccttgtacaatcggtaagtgtcactggctgaatcagggccctggtcgccattaaacttctcagggtgcatttcaaaccatttgtcccatgttgaggccgacttaccataattaagcgcatagccttctgattggggtgctgacgtggctgcgccccacataaaatattctggaaatttgatcatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggagtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgttgtcgtccgatcttttaaccggtatgcccaaaggaaccgtgatttgcgatcgattaaagttaataaaactgccttactatgcccacgaggaccaacgactgtatctagttcaaaatcgccgatgcgcttacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaattatgcaaaaataatttgatagattcctgcaccacagattgcgccaataattggtgcaacgactggtacccaagcataactccattgtgagtcgcctttgttcttaagtggtgtcaacatgtgcaccaaacgtgggcctaaatcacgagctgggttcaaggcaggacctgttgggccacctaatgaagccactaatgtcataaccaataaaccaacaacgatatgtccggcagcgccaaacttaccagcaccgattgctaaagcaccgaaaactaagataaatgtaccaaggaattcgtttacgaaaccattcatacggctatgagcagcatcaattgtaacgaatgatcctaagataccttcttggtttgttgtgcgatcgtaatatggtttgtaagctgcaaccaataataattggccaaccattgcgcctaagaattgaacaatgatgtatggtaatacgttttcccatgggaataagcccatcactgcaaaacttaatgtaacagctggattaagatggttaccagaaatgctaccaaacataacggcgggaatcataaccccacaaccatatccaaaagcgattaaaaaccaatcactactaaaaccttttgttccttttaattcaacgttggctactgccccgttaccaaaaataatcataattgcagttccaataaattcggcagccaaacgggttgtcaaagaagcatccacatgaacttaatgttagccgttattctctatttcggcttagccatcttcggattgggcttattactactcttgttccttcttatctttaaaaaaagcattaaagccgcgttgattattgcattaattggcttgctcgtcgcagccgcaccagttggttatcaatactatctaacacaaaaggctgctcatgaggcacaagttaaacttgaaaaacgcgagaaaaacttcaataaacatgaacgtcaattcttaaaacacatcaagcaagcaactgcttcaacagaatatgttgctcaaaaatacactgccacttgggaaaccttaattaaggatggttctgtcacaatcggtgattcaacttataccgataatgaaagtgcaattgctggtgaaggtcggcttctagttgccaaaggtaaacttgatgatgctgataattactacgccattgcgcaaaccgattatgagagcatgaaagattacaagacgagtcataataaagaacaactggtctatgctaagaacgttttagataaaacaaatgcctttatcttagcagcaactcgtcctaatagtatgtatcaagattatgcagatgatatttacaaaaccaataaacgtcacgtccgcgcgatcgatcagctaaagaatgctcgttcaactgaggattaaatgcgtcgaataaagttactgagtttgttaatgagtcttcttttactactaactgcctgcggtaatcccgtagcggttaagcttcacgaaaatgggagcgggttcaatgcaaccgtcactgggaaaactaagaaaaaacgtgtctattggcaaattggtgatcaaactcattctgtaaaagtaactgatgacacttttgaagttgatattccctacaaagctaaagaatatcgcgtcacatttgctgataacgaacaacttaataatccaacatacttacaaggtcctgctgcaacgccaattacaaaatggtcaactttcatcgcacgttacaatcctttagctcatcaaaagaatttaggtgttttcgatgctaaatcaattgaaggtatccgctctgatcaagttgatgaccataacgtcatttctatcaatgctagcagcggtgaaattttaggaatttctgttaagtcgctagatgcaaagaataacctaatgtttaaaaattacctaactgcctttacgacaagtatcggcagtccgaaagaacagatcaaaaaactagtcaaccagtctttcaatcaacctaacaagctattacaactaacaactaaaaatattcgttactcaattatcacaacaaccaatcaaaaacataagatgacgcaacttgcgattacgcacgctgaataaatgttagaatatcataatattttagttggattagacggttcagaattagctgataaggcgcttaaacaggcgattgaagtggctaaacgtaatcatgccaaactttttattgctcagattattccggatgaagtctctgtcagcacaagtatcacataccccgcttcttctctagatgctgaacgtaaatcaacgaaactctatttggaagaaaaagcacaagaagccaaagatcaaggcgttgaagaggttcaaacaatcttcaaggttggctcaccacggcgtgaattagccgttacgattcctcaagaagctaatatcgatctaaccattgtgggtgttagtggtaagggtgctattgaacgccttctcattggatcagttgcgcaattcatcagtatccattccacaactaacgtcttattagttaaataaatgctggcaattctattagtgattttggaaattcttattagtacggcccttattctctggaccaaacatacttgggatttacccgttcttttaatgggcggcggtctcatcttattagcactttttacgcaaatgtggtggcaaatcatttgcattagtctactgataactggttatgaactactcgccagccactatcatctatagttgaaacttaaaaaaaagcatcgcttaaaactactaggattactattggtcgtcggcattggtttgttcattgtccaatctcaattagggaatccactattaaaaacgcaaaacgcccagtctgcacaagatatcactaaaaaaccgaaaaaagtcctattagatatcaaaccaatttcacagtttccagaattaccaaccggctgtgaaattaccgccgtcgcaatgctgatgtcatacaaagatgttgatttacccaaaacagctatcccggaattgattccctacacagacaccggcgacatggaatccggcttttggggtaatccatttgatgattctggttacactatgtacccacccgcttgggccgatttattcgatcaatatctaggtagttttaccgacctttccgacgcatccgtttcaacactgaagaagacacttgaccaacaaaaaccaatcgtcgcttggattaattaccacggccaacctgcccattcagttttaattatcggttatgatcaagatcatttcttttttaacgacccttacacgggtaaacgtaaaacaatgacgtttaagactttctggaaaattgcgagttatcaagggcaccgagcaatgacctattaaatgtttaagcaccaaacactcacactattattaggcactagtctcttattattaacagcttgccaagcaaaacaagctagtactaactcagcatcatcttcatctcaacaaccagcttcacaatccgaaacggcttcctcaaaaatagtctccaaaacaacaacatcctcatcaacaactagtcaggcggttcaagaaaccacccattcctataccgatagtcaaaaagcagcgattactcatgatttcttaaattgggccggtcaacgcgctgaagttggtaatatggctgttagtgactggtactttgaccatggtgctgacgatcctggtgattggtacgccgaaacaccggatggccgaattttagttcaacacggtgaaggtgatggtcgccactaccccattcaagcagttggtggttgcatcttttatacagcgttagatggcacaactggtatcgattcacaattatacgattcctacgccagaaactatgctagcaatatggacatgagccgcccaattagtaaatatttattaggcgataacggtgtagtttatgaacttaaaacgggtaacggtcaaactaccaacacggaagatggctttgcattagcaccatttagcggtagtagaaataccacgcccaccccatttaccgtttcacaagatacggccgcacaacaggaattaaaatcgttgttagccgcctattaaatgaataatgcagctttattagagtatctcgaagcaaactcgcgtgccctcgatacctttcgcgataaaagtctcgattatcaaaatgaaaaaaatatgaaacgccaacccgctaaacgttggaatgaagctaagattgatcgcgccgtcgataagatggttgccgaatttattgctagtatccaacaaaagatggcctttaacattcggggtgaacatgccgatgagtaccaaacgtgggtcgatttcatcgaacaaaatgaggtcttagaaggcctcgaagagtcagtcaatgaaatgacatttgaataattatagacgttcatttaattctttgccaagttcttcgaagccaggtttgccaagtaatgcaaacatgttcttcttgtaagcttcaacaccaggttggttgaatgggttaataccatttaagtaacctgagattgaaactgctaattcgaagaatgtgatcatgtaacctaatgtgtaggctgtttgatcaggaatattaacggtcataacaggaacgccaccatcagtatgtgctaaaacaacaccttggtaagctttcttgttaacgaagtccattgtgtggccttctaagtaacctaaaccatctaagttttgttcgtcggctgggatgtcaatgtcgctgttaggtttttcaacgttaacaacagtttccatcaagttacgacgaccttcttgaatgtattgacctaatgaatgtaagtcagttgagaagttagcgcttgaagggtagatacctttttggtctttaccttcagattcgcccatcaattgcttccaccattctgagaagtattgcaatgttggttcgtaattttctaataattcagttgtgtaacccttacggtataagatgttacgtaatgcagcatatttgtatgcatcattcttagtaacgtctgtatctgtatattctaagcgtgcgtcagcggcacccttcattaattgatcaatatcgccaccagcaacggcaattggtaataaaccaacagctgttaatactgagaaacgaccaccgatatcatcaggcacaacaaattctgcatagccttctgcatctgattcagtcttcaaagcacctttagcgcggtcagttgttgcgtagatccggcctttagcttcttctttaccatatttcttgattaacttatcttttaagacacggaaagcaattgaaggttccgttgttgtccctgattttgagataacgttgattgagaaatcgcggtcaccgatcaagttaactaagtctgataagtagcttgaactaattgagttcccagcgaataaaacttgtgggaaatcgcgttgttctgctggtaacatgttgtagaacgtgttgtttaagaaatcaattgcagctttagcgccgaggtatgaaccaccgataccaattgcaacgaagatttctgaatcgctcttaatcttagcagcagcttctttaatacgtgcaaattcgtctttgtcgtaattaactggtaaatctaagaagccacgaaaatcgttgcctgcgccagttccttcacgtaattgtgaatctgcagcattaaccattgcttgcatttctgcaagttcgtttgattgaacaaatttgtccaaacgtgatgcatcaaatgaaatatgtgccatatgtctaaactaaaacgttttttaccactcatcttaattttcagtagtttactcacactgctaggtatcaaaaaaattaaagaagcccaccaacctgatttgccaaccgttggtattttacaacccttatcccatcccgcacttgacgaaatccaccgcggcattgtcgcaggtttagcgagtgccggctatcataatcatcaaaatattaaaattgattttcaaaacgcacaaaacgatcaaagtaacttgcgcctaatgagcaaccgctttgttacagaaaaggcaaaagttaccatcggcattgcaacaccagccgcccaaagccttgctaacgccactaaacaactgccaattatcctaggcgccatcaccgatccggcaagtgcaaacctggttaaaaataaccaacatcccggcgccaatatcaccggcgtttccgaccaagcacccattcaaaaacaactcgatttaatgcaagccatcatgccgcagcttaaaaccgttggtatcttatattccagcagtgataactcggcaaccagtcaaatgcatttattcaaacaactcgctgaacaaaaaggtctccaagtcgttgaggccagccttagttccgtcaacgatcttgaacaggtcagccaaaatctagcgcctaaagttgacgcaatttacgtaccgaccgataacacaattgccagtgcgatgggcacacttgtccacgtcaccgataaaaccaaaacaccggtctttccttcggctgaaacgatggttaaagacggcgggcttgccactgttggcttgagtcaatatgatttgggcgttgaaaccggcaaaatggccgctgccgttttaagcggtcgttcaaaacccgcttcaacacccattcgctatttacgtaaaggccaccttgtcttaaatctcaaaaaggccaaagacttacacatcaccattcctcaaaatcttgtcaaaaccgctaaagaaaaaggagcgattgtcaaatgaatgagcctcattatttcaaccatcgatcaaggattattatggagtttacttagtttaggggtcttcattaccttccggattctcaaatttcctgatatgactgtcgaaggtagcttcccactaggcgcggcattaagtgccgtcatgctacaacaacacaatatcgccctttcgctactcgttgcctttgttggcggttgtcttgccgggttagtcactgctatcttatacaattattttcacgttcagagcctcttagctggcatcttgacgctaaccgggctttattcggttaacttgcgtattttaggccaagccaatcttgcaatcggtgaccaacataatctctaccaattgccttttttacaacaattaactgtcgatcaacggctactaattttgaaccttatcattattgtcgtggcgatgttggcccttgccctattgctctatactgaattcgggcaagcactgattgcagccggtgataatccgacaatggcgctctctcaagggattgccgtcaaacgaactaagacaatcggaatcgtcctttctaatggtctcatcgctttagtagggggcttggttgcgcaatataacggctttgcagacgtcaatatggggattggtgtaatggtcattggcttatccgccatcatcattggtgaacggctattagtcagtcaccacttcatttctaaattaatcagcatcatcctcggaagcatcgtctaccgtttaatcttattattggttctccaacttggctttaatgctaatgatttcaaactgttctcagccattatcctcgccatcttcatcattgcaccacaacaaaagaaaggaatgaccacaaaatgaatgacgcctcgtatgactttaaaccaaataagttatcaaatatctgatgataatgaccaaaaacaattactcgaccagttaagccttgacatcaatcccggagaattcgttgtgctactaggagccaacggtgctggtaaatcaacttttttcaacactgttgctggtgatttaacgccgaccagtggccaaattatttttaacgggcaagaaattaccaagcagtctgcccaacaacgaacacgtttaattagtcgtgtttatcaagatcccaaattaggaacagccgctgatatgaccgtcgccgaaaacatcctattagccatgcgtcgtggtcagcggcgtcgtttgttgccccgtcgtctaaaacaacaattaccgcaaattaaggctctcgccaaaaccttacccaatcatctagagcaacagcttaaccgaccggtcagcgccttatctggtggacaacgtcaaacccttaacttcttgatgacaactattcaaaaacctgaattgctactattagatgaacatacatctgccctagatgccgtttcaagccaggcactgatggcttttacagatcaaaccattcaggataatcaactcacctgtttaatgattactcatgatttggaagatgccttgcattatggtaatcgtcttttagtattaaaagccggtcaattaattgctgattttaatgcggtggaaaaacaacaactgacaactgaaaaactccttaattatcttaatgcctaaatgactggtacaaatactgaaatgcaaaaaactattccagcaagcgttgcaatgcttcgtgttcttgaatcttggggagttgaccatgtttttggttatcctggtggctcatttaattcaacaatgcgtgcattaacggttgaacaagaccgacttaaatatatccaagtacgtcatgaacaagttggtgcacttgctgctgctgctgatgctaaattaacgggtaaaattggggttgcttttggttctgctggtcctggtgcaacaaatcttttgacaggcttatacgatgctaaagaagatcacgcccctgttttagcattagttggccaagtcccaagtacaaatatgaactacaactacttccaagaatttaatgaaaatccaatgtttgatgacgtttccgtttataaccgcctcgttatgacgccagaaagcttaccatatgttgttgataaggctattcgtgaagcatacaaacacaagggtgttgcagttgtcattattcctaataactttggttacgttgaaattccagacacaccatacagctcaagctcaccaacagatcgtaaacaagttgcaggtcctgttgctactgatgaagaagttgaccaattcttagcaatggtcaaagatgccaaacgtcctgtgatccacgtcggtcgtggaattaaagatggcggcgacaaactcgttgaattatcgaagaaattacaaattccaatcgtcatgactggtcttgcaaaaggcttagtacctgatagttatgaaggtaacttaggcatggctaaccgagctgcttcaaaagctgccgatgaaatcatggccgttagtgatcttgtgattgccatcggtgccgacttcccatttgctaacttaatttaccggacacacgactttaaattcgttcaaatcgataatgacgaagcacaatttggccgtcaccatttcttagattttggtatctggtcagatgcaactacttttgttgaaaaagtggttgcccgtagtcaagctgctgcaccaagtccattcttcaaggctgccgttgctgatatgaagaactggcaagcttatcttgatgccttaacaaatcggccatctgatccacttgaatttgaaccaatctataaagaaatcaatcggattgctgacccagatgctgtcttttcaattgatgttggtgataatatcatcaatagtttccgccacttgcacttaacaccgaagaataaatgggtaatttcagccctctttgcttcaatgggctcaggcgtgcctggtgccttagctgctcaactcagctacccagatcgtcaagtcttcaatattgctggtgatggtgccttttcaatggtgatgcaagatttaatcaccgaaaagaaatatcaattaccaatcatcaatatcatcacttctaatgcttcattaaacttcattaagagtgaacaagatgatttaccaatggattattcaggaatctttatcgaagatcaagacttcgcgatgattgcccaagcaatgggcgttgaatcaatcaccgttcgttcttctaaagaattacctgccgcttttgacaaagctcttgaagtcacaaaagcgggtcgcccattcttaatcgatgctaagattactgacaaacgtagtatccctgttgaagaattagaattaaccatcaaagatggcaagcttacagaatcaattagcgcaagctatgatgcttctcgtcctaccggcaaagaatacagcgttgctgatttcttcgctgaatatgatggtcaatcacttaaaacattgccagaattattcgcagaaaatggcgttaaactctaattaattttcagcaatcgtttctttgggatggaaccaaacaacgttcttatcgaagaatgatactaaatcgtttgataaatacaagatgtaggtgaagaagagtacccagtttgaacccccttgcatcgctgtgatgccccatagcgtaatcgaaacaatactttgaataaaccagaagtagtaactttccttaaaacgtaacgttgtcaataacgcaccagtaaagccaactgaagcggcaacactatcaatcaacggccgtgggctgtctgtcatattactttcccagagatataacaagcctactgaagcagcgaagaataataacgtcagtacccagttacgaagacccttaccgcgactcgcaagaccacggacttttttatcgacattttgtgcccaatctggcatcaataagaccggaatgtctaacataataatgtagactgtttgtaataacatatcattatagtttttagcgttgtaagccacaataatgtagattaacgcagaaataatcccaaaaacaccatttaagggtttggtattagtgatactaatcgtacatgtaaaacctaacatgcccgcaaacatcgttaagattgaaacactgttaattggtccacctgaaactgtggcagctaaaataaaacccaaaccaaacattaataagccataactggctgttgtccagcccttcatttgttggatataccactttggattaaatacactggcgattgcacgactatcttgcatttaagcccggtaaattgttttagcagcgttcattgccgaccaagcttttggccaacctacataaaaggccagatgcgtgataacttcgacaatttctgcctcggtaatgccgttttccttgccaatttttagatgtgctggtaactgttcgaaattaccaccagaaattaatgcactaattgtaattaaactccgttgatgcgctggtagttctgcttctcgtgaccagacttgtccaaataaaacatcatcatttaattcagcgaacttaggtgcaaaatcacctaataaatcgcgacctgccgtctgtttttttgccatttaatttgttaatacgtcataatcagcatcagaaacagcctctagccattcaggtgttccagctgtgattgcgatgtggctaaaccaactgtccttagtggcaccatgccaatgtttaatcccgtctttagtgacaatcacatcaccaggcaccaaatgttgggctgctttcccggcttcttggtaccagccttcaccaccagtaactaataaaatttgataaccatcatgatgaatgtgccaattgttacgacagcccggttcaaacgtgacattaccaacgttagcattcacatctggttcgttaaccaacattgataaatagctttgcccaacaaaaaaatcttggtaagccacattcggttcccctactgtaaataattgttctgtttttaatcgttcatttttaaccatttatgattcgaatcgctgtaaataggtttcaaagctttctaattgacctatcgactggtctaatttgccatcataccagtctattttgcggcccattatcaccaagttcgcttgtagctcagcgacttcggcttcagcgcgtgctttaacctgctgcaatagcgccttgcgcgcctcaatcgttggatcaccttgcgctcgcaattcaacatagttctgtaattcggtaatccgcatccccttcccttttagatggaggataaaaccgacccatttaacatcctctaacgtgtaatagcgtaacccggctgcatcccgttgtggtttgattaaaccttgttcctcgtaatagcgcaacgtatacgttgataatcctactagcgttgcaaattcaccaatcttataatgtttttctgccaattaataaaccggtcgatcaccgtccgtattaggctgattaatcccccaacttgcgcgaataccaagggttggttgatcaattaggtctaccaccaccttggcgatactctgtcgtgaaatgatcgtccctttaaatggtgtccctttttccgttaattcataatcaacaatcggttcgtcggtcatataagcacaccgtaaaatcgtgtagtctaatagcgattgttcaacaactgctgctgctctgcgcgtatcttccatgacatcgtgacccacagcacgttcattccacgcaccaaattctcccggcacttcatgataaagacctagcccactgatataaatcaaccgtttaacaccggtcgctgtcattgctttgacgacggtcttcattaaaggttcaaattcgccacctaaattagcataaacgatatcgatccccttcaaagctgccgttaatcgcgcttgatccaaaacatcgccttcgataatcgtcacatgcggatttgtttttaaagctgccaatcgttcagcattccgcagatataaaactaattcgtgttgcttagctgctaataaatcttgaataaccagctgtgcgacttggcctgccgcacccaatactaatattttgctcatgtgactaaaaaattatctcttgctcaaaaaattaacgtcatgcgagccagtgtgatgggcgccaacgacgggattctttccgttgctggtattgttattggggttgccggtgccactagcgatcacttcgccatctttatctcagggattgccggcatgttagccggcaccatctcgatggcgatgggcgaatacgtctctgtcagcacacaaaaagatgcgcaagaaatggccattttcaacacacaactcaatctaaaaagtaattatgaatctcaaagcgcttttgtccgtcaaaaatacattaaaacgggtatcgcaccggaattagcgactaaagccacccaagaaatgatgactgctgacccactaacaactgttatccgggaaaaatacggctttttacctaacgccttcacaaatccttatgcagctgcgattgcttcatttatttcatttcctatcggttctattttgccactagcagcaattacccttttccctaatcgcattagcgttatcgcaactatcatcgcggtgatgattgccctagctattactggttatagcgccgctgcccttggcaaagctaatcgttccaaagccattactcgaaacgtcgtctccggtttattaacaatgattgtcacttacgcaatcgggacattgttcaaacaataaatgtcgatttcaaaaacaactaccccttcaattgaaaagccccaccaaacaatggaagaaaagatgaataccttacgggctggtgttttaggttccaatgacgggattttaaccgtcgttggcgtactttttagtgttgccgccgccacaactaataatttcacgatttttatcgctggcttagcagacctactagcctgtgccttttcaatggccgctggcgaatatgcctccgttagttctcaaagtgacactgaaaaggctgccgttgccattgaacagcaacgcttaattcatgataaggaaggccaaatcaaagaagtacaagccttctacgaatcaaaaggcgttacaccagaaacctcactagcgattgccaaagatctcatgtcgaaaaaacctttagcgaccatcgtcaacgttaaatacgatttagaactcggccattatatgaatccttgggcagcagcctttgcttctcttttctccgcagccttcggtggtgttttcccattatttgctatgattattctccctgaagcctacaaaatgacggggaccatcattgccgttactgtggcggtttccattacagcttatatcagtgctaaacttggtgacggtaaggtcaaagtttcgattattcggaacattctaatcggcctagtcaccatggctattcactacggcatcggccaacttttctaattaatgattaattttatttatcagaaaccaggcaatcttttcatgaccggcatcattgggatgcaaactatcgagactaagagcttctgcttgttgcgcatcggcaaaagataatgccttttgattaaagagactgatatgcgtaattcctagcaattcagtgacttgaacaattgccttttcgtaatcggcttgtcgataaccactttgattgatggctgggaaaaaatccgttccaattttgacatgcgatataaaataaatcgttgcttgcggataatgtttactaatctggccaagcatttgctgcaacgcgccgtaaaaagtcacggtcgtttggtcgccaaattggcctaacgggacatcgcgaccaaaatcattgataccagcatagattaataataaatctgtttcagttggtatctgttgccagcgattgaccattggatcgtacggttgggcaatcgttgagccggaaataccgagattggtgatcttaggaatcgctaaccagtccaccaaccattggtaataccattgatgcgcatagtggtttcgttgatcggtgatactatctcctaaaaccgttaaatgttgataatgtctcactcacctgtcattcactcctattaccgaataatctatcaattgccagttatttctttgccaataagccatcgcttgtaacgtttttagcgtctcaagctcaaccaagcggttagtcgttagactacttttttgcctcaaagcactagataaatacccgacatgacatagaatgaccggtggcaccgtttgatcaactaacagtaattgttgttgaatatcagcgggtgttaagtatggcccttgttgcgccgtgattaatgcaccagtcgttttaaccgtgctcttttgccacaaatcttgataagctgcttgctgtttaaggggtaacttagtcacttcatgacgcagtggcacctggtaggtctgggccaactcgagcactaccgcataaatggcaggcgttaaagtggcgacaaaatgatgtgaggtcagatgggtcagttttaaaccgctcgctaaaaagcaatcaatctgggcctgaaactcacgtctgacctcattgatatcaagttcttgttcacgtgcttgtaagttcgcatagcacatcaatcggccagttgttgtcaccaaacttgggatgttttgcgggtcacagatgggtacatccttatcaagtacaagatggagccccattccctgaatccccatttgctgagccaagaccgcactcgccgcaaaatctggtgacgtcacttgtgcattggttgccgagagcagtccccgctttaaccctaatataatcgcccgtgaaattgggatggtcatcccaaaatcatcagattcaacaataattgattgcatttattctgcgctcaaatcgaactgtccaatgacactgtccgtcgtcactgctgctggtagtggttcggctggtgtaaacgtcgcattgctgctgacgaccatgattgtattagctttatcagctgcttttaattgtgcccagtcgattgtcacaagtggttcgccagcttttactttaaaatcagcttccacttgcatttcaaaaggtgcaccttgtaattcaactgtatcaatccccatatgaatcaagacttcaacaccttgtttcgttttaatcaagatagcatgttttgttggaaaaattgaactaaccacaccatcaactggcgcattaatcgtattcgtcatttcgtccggcacgatggcaaaaccatcaccaactgccttactagcaaatacttcgtctgtcacttgttcgattggtaaatagtgacctgtaacgggcgctgttagttggcccgcaggtgcttttttcataaatttaaacatcatttattcaatttctagcataacggcttcatatggtcgtaatgtaatttggtcggtcgttaattgttggtctggataattactcatcatcaccgcttttacggccgcgttagcgcgttgttgcgtttgatctgtaaagtttgcgatcacacggacttttttatcacctaactgtcgttgataagtataaaccgcttcatcttctggtgccaataattgatattgaccttcaataaggacaggttcagtcttacgtagcgctactaaatgttggtaaaaggcaaagacactatctggtgcttgtgctttagttgccaccgaataatcatccgcaacaactggttgcaaccaaggcgtaccagttgtaaagccgtgattggtagtcatatcccattgcattggaatccgacaattttcacgcgatttttgttgcaggatttgaagcgctaaatcttcactaatcccatcagctaacatttggtgatatgcattaatcgattcagcatcttgatattgatcaatcgaagtgaaattagcattcttcatcgcaatttcttccccttgataaatatacggtgtgccttgtaacccaaattcaactaatgccaataacttagcggattgatcacgatactgaccatcgtctaagaaccgtgaaatcgcccgtggttgatcgtggtttgaccagaataatgcattccagccaccacctgctgccatttcagtttgccattgacttaaaatccgcttcaaatcagacagacggtattgccctagcgtccactttttaccacccgtataatcgactttaacgtggtggaaggtaaatgccatcgagagttcttcacgttctgggttcgtataacgaattgcttctgaaaccggcgttgatgataattcaccaaccgtcacaaagttgttagggccaaagacgcgttcatacatttcatgaatatattcgtgaacgtgcggaccgttggtataaaagttacggccatcgtcactcggtgtctcgaaggtatcatttggaaaatctttatccttcgagatgttattgatcacatctaaccgtaaaccatcaatccctaaatcagcccaaaactgcatcatttgatagatttcttcacgcaattgtggatttcgccagtttaaatcaggcatccgcttctcgtataaatgtaagtaatactgatttagcgcggggacatactcccaagcactaccactaaacttagataaccagttattcggttcatgaccatcaactggatcacgccataaataataatcgtgataaggattgtccttgcccttcaaactttcttggaaccaacggtgttgatctgaagtatggttgaccaccatatccatcataattttaatcccccgttgatgagcctctttcaaaagccgttcaaaatcagctaagtcaccaaaaattggatcgatttgataataatccgcaatatcatacccattatcccgacctggtgagacatacatcggtgttaaccagattaattcaatccccaaatcttgtaaataatctaaacgttggataatcccgttgatatcaccgataccatcaccgtttgaatcttgaaaactccgcggataaatttgataaactgttgctttttgccaccatttcatctatgccgttacttttttagtcgtacctggtttttgtggtttagccattccttgcccttcttgcatttggtcgttataaccccaaacgtaagtgacgataaatggcacaattgtcgcaaccgctgaagcggcaatgaaaatccagaggtttgataaatctgctgggtgttttggatctaagaatgatgcaaaaccaatccatgaaccggcaaaaccaaacatattaccatgtaataagccgctgacaaagccaccagctgctgaaccgattaagccagagatgaaaacccgtttgtatttcaagttaatcccataaatagcgggttctgttaccccacagaaagctgaaattgcaccagcaaatgataattcttttaaagctgttttccgagttttaatcgcaactgctaatacagcagccccttgtgcaaccattgtcgtacttaaaatagcgtttaaataactgtgtccggaagtggccacgtcgttagcaataattggtaaaattccccagtgaagcccgaagataacgagcacttgatagaagccgccgattaatagaccggataaccaaccactcttcaagagtaagaattgaataccaaatgctaagccgtttgataaccaaataatagctggacctgtaatataaagtgtaatggctgcaacaacggcgattacaattagtggtgtaaagataatttgtaagtagcctggtaaccaattcttaacccatttcgttaatctagcaaccaaccaagctgctaaaatcattgggaaaattgaatacgtgtagttcaccattgggaagtttaacgaaccaatctcaaggagtgatttaccgtttaaagcgactaatgatgggtggactaaaacgcccccgataaccgctgttaagaccggatcaccttttaatttcttagcggctgtaaatccaactagcattggtaaaaagtaaaagacagaatcgcccatcgcacttaaaatgatgtagaattcactcttttgactcactaacgcgcctaattgcggcatcgttaacattgctaaaacaccttttaaaatcccgccggcagccaagattccgacgatgggactcattgcaccagtgatgacaccgattaattgactaaaagcgtctttcacgtgcccccatggtgttaggttctgttttcttttagttgttgcgaccacttgggctgtttcatcttcatcggcaaagtctgcgccaatttcagcaatcacagcgtcataaacggccgttacctgattcccaatcacaacttgatattgaccagatgctttttgaacattaataacgccatccaaagctttgatggtttctgtttgtgcctttgattcatcttttaaataaaatcgaagtcgtgtaatacagtgaattaaactatcgatattttctttgcccccgacaccggcaacaattgcttttgcgagttgtgaataatctttttgtgccatatgtcgaaaaaatatgaaataatctaccgcgaactcgtccataaaattacgaaccatgtttatccagccaactcattcttacccagcgaaaacgaactcgcaacagcgtatggtacctcacgcgaaacagtccgcaaagcactcgctagccttttagaaaatggcttcattcataagatcaaaggcaaaggctctttagtccttgattttgataaatacgcctttcccatttccggcttgaccagttaccgcgaattggatagtctctttgaaatgcacacgcaaacaacagtcctacaactccaaaaagcaaccgtcccacaagcgccttttcatttagaccccacagagattctacccgcgacctatattcaacggttacggaccgttgatggtgaaccaattgttatcgataacgactacgttctaaccagtgttgtcccagaaatctcacgggcagtcgctcaggattcactttatcactactttgaacaagaattgggtctaactattggttatgggaataaagaattcactgttatccctgcaaccgaagaacagtgtgccattttaaaactcgcccctaatagtgcggtcgttagtgttaaaggtatcactcatcttcaggataataccttaattcaatttaccgaatccattcaccgggctgataaatttaagtttattgaacacgcgcgccgccaatcaatttaactaactgtttagtgcaccaatgctatttaagagttgatttaattttagtcgttgctgtttttgaatcgttcgacattgatttaattgttgttccacttccgactcttcagtcaatcgcatcgcattaacaaaatcctttgcagcagtcacataatgcttaataaccatctgtaattgctcatgtaatgcgacaaattccgttggcggttgaatacgcgcaatttgatcaacaaattgatcgaggaccgttaaattctgtctggaatagtgattaagtaattgtaaattttcatctaccaatcctttaccccgcataatatttttactagtttgcgaatattcactaaaaaccgtttcgaagacaataaaccattctaaaaaccgattccattggatcacataagcttgtgccgatagctgaattgttggttgtaacatttaaacccgctttcgccatcgtgacccgatcagtattattaaccagatcaaaagtgtacccaaactaatcagttgtccaagcagcaaccccggtgcccgataccgtaactgtacctgattggtgccacgttttaatggcactgctagcatgttggccattacctttttaggtttaatcatttgcccgttaaccttagcttgccaaccagcatcatacggaatgctgagatacagtagttgattagatgccattgttttaatatcgccagtgacatgtccgttatcttgccataaagcagtcgtcgttaatttttgctgatcaagttgtttgacagcttgattaaaccgttcttgattgagtgtcgcaacttggaaatgattaatattctgccgtttagggctaatcacagttaatcgtagcggttgccctttatgcgagtcctcaagcgggataattgcagcactcgtcactctaatcggcgttttcttcttacgaccgttaacaaataatttaattcgcgctaaattttgatgtggtaaatataaatacgtaggaccttgcgtatctcttggaatttctagcgtataccggtagctatgggccttaatttcttcatggaccatattaacccgatgatttgtataaaatgcttggtcagtatttaccattgcttgtaacaaccgatcctggttgtcgaatggccgatgctttttcaaagtaacatgcgctaattgccgattaaccgcaaaacccaatccaagcgtttgatgtcgttgaataaccgtttgctgattttttggttgtaaatcatagcgattggcaaataacagatccgtaatcgctgtatgtccgaccccattaattcgccggacgttcttactgtaaaaaccaaggtccaccagcatactgcgcatttgttcgtccaaagttgatgagtaattatttaacgtatattggccaaataacaaggcatcgttgtagccataataaggttcgcgatacgccgattttaataagatcgactggttattgacccgataaaaatcattatctttttcactgagttgttcatacagtgcagcttggcgttgatattgttgcgcatattgtttttgataacccaatggtattttatgcgtcattaattgaaaattagtgactaactcgccaaatgataccaaaacaacgcctgttatcagtattttttgatagtgacggtttgtttgaccccaataataaaataataacccgagaaatattgtatagccacttaataatatccatgattgtactgtaacttgcggataactctgattaccgtgtaatctcaattgaccaatcaccaataaaccactcactaaggcaatggaccaccctttagcctttttattttgcccttgtactagacttgcttcgtaggcaattttaattaagacaaacgagaataagtaagcattccggtagggaaacccttctggctgttgaaacatatgccaaatagtattaaacgttgttacccaaaaactaagggttaaactaatcactaaaaagccattagcgtacttcgcctgttttcgaatttgtggcaacataaaatataaaaccgcaaacaataatgccaatgtgcccacaaaaagtgttggttcgtgcgttaatcgttgtgtatagcgactaccaccgacctgaaattgcgtaaacacttcccagccaaattgtggtgtcgggtaaaaactggtcatggcaattgtcttttttccagtctttaacatgcctaacaacgctgggaggaggataatggcgcttaagccaccaacaatcagtgatgaccaaataaactgccagataacccgtgcttgctgctgtaataaatgcccccacttttgctgtggttgccgttgcttaattacaaggctaatcatatataagacggcaaataagcatgtcatgtaacccaaataataattggttagaatcgaaatcgtcaacgtcacaatgtaaaatgtcggcttcttaactgaaaataagcgttcaaggccgatgacaatcagtggcactaagattaatgcatctaaccacatcaaattataaaaattcatggctacaaagccacataaactataagccgttgaaaaaatcaatgcggcataatgataagtcgttgtccgtgttctcagaaaataactcattgtcacgcccatcgtacaaattttaagcgcaatcacgtaactcaccataactggtaactgactattcgatcctaaaagtaacaatagattaaacgggctaatcaggtaataggccgctagcggcactaaattgccacctagcgataatgaaaacgagtaggcactgaagttaagatgagcgacttgccgcttgaattcagccaaaaatggcatgtactgtgtccctaaatcactaaacaataaattatgattaccaaaaggcactagccccatgatggcaaaaccgatcaagaccaatactaacggcaatccgaaactgagaccgtaatagctgatcgcctgtttacattttgtttgcatttatttcatcattccaagtgtcacgccaccgacaatgactagtaaacagccaagtgtgacatacaccatttcttttttcgttttacgttcacccaagaggtagatactaccaattgttgaaatgataatcccacattgtgaaagtgaataactgatggcaagaccgatatctgacattgaaatcaacatgaacaagtttcctaagccccataatagacctgttataatgttcaaacctgttttcttatcaaagactgctttaccaataccaacgccagcaaagatagcagcgccgataaacatcccaatcgcttgtggtaagacgattgttgttgcactaattcctgaccagttaacaatgattgtgtaaccaccataaccgattgttgaaagaatcaaagcccgaaagccacgtgcaaattgtgtatcttctttagcagctaagctactcttaggatctttcattgatgttaacgttgcaccagcgattaagatcactaatgctgtaatcccgaagatataatcatgggttgttttccattcgtggaataacaaagcgcccgctaaagtgtttacaatcaattgcatccctgttgataatgggacggtttttgaaacacccattgcttgcattgattggaattgttgcccttgaccaatgctccagaataatccggaaatgacaccgattaccatgatgaataaatcaattttaggttgaataaccaaaaaggtaccgattccaaaaaccaacgcaccaatcgtcatcccaaaagtttgttgataagcgttaccacctaatttaccacttaccaatccgatactaccccaggcaagtgctgggattaatgcaattaaaatagccatttaatgttttaaaattcggtagcctttgtacaaagtcaccccgataatcgcgccaagtgtattgaagattaaatcatcaatatcggccattcctgttcctaaaataaactgggcggtttcaatcccaaatgaaaatagtgcgccttcaataatcgttaatagccaggtcccttttcgatctgttaatgaaccacgcaaccacccaaacggcacaaaccacagaatattaccatagaagttataccagtaatctaattgtgccggcgcattccgtaacttaaaagtctcgacaaacggtgttaagttaatttgggttagagagcggttgacatataggtgcatctgccaaggataataaatatggcgtaaaaccgttaacgataatagtagacatagatagaagacaaatataaaaagtttcaattcatacttaaattgaatccgacgttttttaaggcctaaatacaataaacgcagtccgataaaaataaaacaatacaaaattgtcttatccaaactctctaccgtcaatttaattaagggcagatgattatattttgtcccccaaggaaggatgatgttgttataaagaccacctagaaataacaaatgaaagttttattgtattttgaaagtcaaaaactactcgctaaatcaggaatcggccgcgcactagatcatcaaaagcgtgcgctaactgccatgggcatcgactacacactcgatcctaacgatactgattatgatatcttacatattaacacatacggtttaaatagccgacgaatgattaaaaaggcgcgcaaggctggtaaaaaggtgatttaccacgcacactcaacagaagaggatttccgtaattcctttgtcggttccaatcaactcgccccttttgttaaacatcgtttggttagcctctattcaaaagccgaccatctcattacacccaccctttattcaaaggcgcttttacaaggttacggtattcaggtgccgattgcgccaatttctaacgggattgatcttgctaagtatcaagcaacgccggataaagaacaagcttttagagcttatttcaacttgaagcccgatcaaaaggtaattatttgtgtcggtttattcttccaacgtaaaggcttgctagattttgttgaaattgctaagcaattacctgaatataccttcatttggtttggtgatgtgccgatgtacagcattccgcgcaatattcgcctgattgttaaaaaggaccatcctgcaaatgtgcgcttccccggttatatcaaaggtgacattatcgaaggcgcttatgctaacgctgatttattctttttcccttcttatgaagaaacagaagggatcgttgtgctagaagcccttgccagtcaccaaaaagtcttggtacgcgatattccggtctaccacggctggctcaaagatcaacaaaattgctacatgggtaccgataatacggaatttaagcaattgattcaagatatcgttgaacaacgcgtccccgacttaactgaagcgggttatcaaactgctgaatcgaaacagattaccgcaattggccatgaattagcggccgtctaccaacatgtcttaacccctgatgaatcaaatccaacttacacgcaaatcatgcagcacactttaaaactttaattgaaactcacaaaaataaaacaatttatggcctctaaacttggctttttaagcctattagtctttttattttgggttaaaaccctttttggttatttcaccgatttcaacctcgcagctagcgatccgctccaaatggccattttaatcttcaatccgctcgcaactaccttgcttgtcttggggattttattgtacattaagcaaccgattatcagttattggaccgggctggtgatttacacggccaacacggcccttttgtactttaatgtcatctattaccggcaattcaccgattacatgacaattgacacgatcctcggttattcaaaagtttccgcgggcctcagtaaaagttcgctggccctaatgaactggcacgatgcactctactggctcgacattatcatcttggccgttttaatcttattaaaggtcattaaaattgatcaccgccaattccctaaaaggtgggcatttagtattacgtccctagccgttttgttattcggtgttaatcttggtctgagtgaaatcagccggccacaaattctctcacggactttcgatcgaaactatattgttaaataccttggtattgatacttttaccgtctacgatgccgttaaaaccacccagaataatcaagtccgggcccaagccgaaagttacgacttagatcctgtcttagatttcactaaacaacactacgccgcacccaatgccgattatttcggcgctgctaaaggtaaaaacgtgatcgtcattcatcttgagagtttccaacaattcttaatcgatttcaagtttgaaggtcaagaagtcacaccatttttaaacagtctctatcacaaccaaaatacgctagccttttctaacttctttaatcaagttggccaaggtaaaaccagtgatgcagaaaacatgcttgaaactggtgtgtatggcttaccacagggttccgtctttacaacacttggttccgacaacaccttccaagcagccccttcaattcttaaacaaaatggcgattataccagcgccgttttccacgggaatgttgggacgttctggaaccggaataacgtttataaaaactttggttacaactatttctttgattctagctattttaatacgagtcctgataacgtcttacaatacggtctcaaagataaactcctctttggccaatcgattaaatatttagaacaactacaacaaccgttctattccaaatttattaccgttactaaccatttcccattcccacttcctaaaacagatggtgatttcccacgggcaacaaccgaaaattccgctgttaataactactttgcaaccgctcattatctcgatcagtcactcgctgaatttttcaattatttgaagagttctggtctctataataaatcaatgattgtgctatatggggatcattacggcctctcaaattccgataataaagctttatctggcgttttaggccgtgattatgacacttggaccgataacgataatgcccaattacaacgggttccttacatgattcacatgcctggtttaaaaggtggtattcaaacccaatatggtggcgaaattgatgccttaccaaccatgttgcatctattagggatcaatagccaaaattacgttcaatttgggacggacttactttccaagcaacacgatcaagttgtcgccttccgaaatcataacttcgtgacgccagaatataccgtcctcgatggcaccatctatcaaaatcaagatggtacggaagtcacccaaccaacagctaaattgcaaaagcaagtcgcaaaatggcaaaagcaggtcaatcatgaacttagcctttctgactcagttaacgagaaaaacctcttacgcttttacacaccaactggtttcaaaccggttgatcctgccgattataattatcaaaccggctatcaacaactcgttgagattgaaaataaactaggcactaaatcaacaagtgtcctttcccaaaacaaaggcaaatcaacagtcccattatttaaaacagatgcccctgagttagcagatgatcaatctagtttaactgaagtccctaaaagcaaagcactaaaagatagtgcagctacctcgtcaagtagtagctcggaatccggtcaatcaacatcagaatagttaacgcgttaatacttgtttcttaaagctctcaaaaacagattcttgtaccgttgtaaagataataattagttcattatcggccgcaatcttgcggacatcgtttaataactgacgcgcatctcgaggggctagttgatctaaataacgcgctaagacgaagacctgttgccgatttgctaaaccacgaataaattgaatccaaaactgatcgattggtttcaacgcgcttccttgtgtcgtccgcacttttttgacatattgatcagtcaagatactaatgactgactgatcagcatccttaggtaacaatagattatcccaccccgataagaacggtaggatctttggttgcgcataatcaatcgtaaagggctgattagggagttgtaatgctgtcttcaacaactctggttgactgaaataaatctgcccgacttctaatggttgtttgttcaacattcaacataccgactcacctcttaaatattttttcttaaaacgactgacttgtaacccaccaatcattaaaatcggtgcggctaagctaatgattgcttgccataattgcccaaaaatttgattggttaatgtttgtttgacactattgtgcagtgtcggattcaaaagagaatgactactaaaatctgtcaaatgatttttaaagagtgggttgagcgttttaggtgctttttgcattgcttgcagtggtcgatgccaataatggttgatcgcttctaatcctcgccagaacggctgattagcgactaacaacaaaaggctgatcgttacgacagcaaaaaatagtaagcaaagcgccgttaagccgtaatacaacgtcactttcgttcgtgtccaattggcactaaaaaaggtttcgatatcacgcgccaaaattttaaacgccaaccaactaatgattactgtggcgatgatcccgacaatcattagtaatagatacgcagtttgataccgctctaagactgtctggttagaatggagtaatgtctttaacgggtgatccgctgcaaacttttcttcagctgtaaaattagctaactgactcttgagttgggttaagttatgtcgttctaaccgaatcaagcccaaaataattgtcgccaggcctaaaaataaacagtccaataaataaatcgctagcgactgccgccaataataatgaatattggccggaatcgattttaagaaaaacatttaaatcacttttttagtttgtagttgaacagctaccctataaaaaagcgctgtgatcaacatggcgataaaggttgcccctgtataggcgtgcacgattgcgaattgatttaagattaaataactgataacgccaatcacccaactgaataatgccgttagatgatagccctttgtataccagtatggtccagcaatcgtattaagcgcgtctacttgatagtgtcggcgtctaatccagaagtaatcgactaagaaaatcgcaatctctggtcctaagaacatcccaatactatctaagaaggtttcaaaggtggtcaaaaatgacgcgacataaactggaataaaggtgacgaccgttgccaacaaagtgacacaccagagtgctggcgttaacttgagctttggaaatatgttagtgagcgctaaaccagcagccattaaattaacagcattcgcggttgtactagtaattacaatcaccaacaaggctaaaactccgagtcctaatttagcggcaatcgtacttggatcagcgttattaggatcaaaatgattcaaagtaatcgcggtcgcaattgtcgccgtcaaaccgatgaaggcaaaccagaataagccgatattagcccctaggaatgaataaacagttgcggccttcttacgcttggcaaaacgactaaagtcagcagctgctgtgacccacgctaaattaaaggcggctaaaatatcgattgctcgaccggcttcaagacgaaacttggcagctggacgccaagccaccagatccttgaacggtaccattttgaaaacaatgattgattcccatgtcactaagataatcacgagtacaatcccaatccgttcgatccaacgaactgatttttcacctaacgaaatactgataagatgcaagatggacatgatgatgatcccaacaaccaagctcaagcgattcgtagcggcatcattgcccgaccaacccataatttctttcaaaataaagctcacagaagtcgccgcaatataggtattaacggctgcccaaccgatgaattgcacgacgttaatgagtgacggtaagactgaacctttaacgccaaacgaagcacgcgttaaacccattgcacccacaccagtttgatagcccatataagaagcaagtgctaataagacataggataaacagccgatggcaatcaacagtgtagagccttgaataagaccagttgcggcaataataccgccgatgtaccacgtcccattattagcgttggcacctatccaggtcgcaaataaatcccaatcacccatcgttctttcagacttagcgactgagtgaatcgtatgttgttttgccatatgcttattcaaaacgttcatatcgagaaccagacagctttaaaatcaattagaattgaaaacggtcttataacagcaattgaatcacatcttgagccccaacaaaacgaaaaaataattgacggccaacaacaattagcgctcccaccgtttgttgacccccacgttcatctcgattcaacactaactgccggacaaccagaatggaatgaatctggcacactttttgatggtattcgaatctggtccgagcgtaagaaaacactgacacaccaagatgttaaagaccgagccctcaaagcccttaaaatgcaggctagtcatggggtccagtttgttcgctcacacgttgacgtcactgatcctgaactagtcgcccttaaagcactgattgaggtccgcgaagaagtgaaagactggatgacattgcaacttgttgccttcccacaagaagggattctctcctttccaaacggtaaggcgctaatgactaaggccgctcaactaggggtggacgccattggtgcaattccccatttcgaattcaatcgagaatatgctgttgaatccttgaaatttgcctttgaactagcccaagaatatgatctactattcgatgcccatactgatgaaatcgatgatcctaattcacggagcctcgaaacaatcgctacactcgccttagaaactggcatgaaagataaggtaacagcctcgcatacaacagcaatgggctgttacaatgatgcttacatgtataagctaatgcgcttattaaaaatggccgatcttaattttatcgctaaccccttggtcaacttattcttggggggcgttttgatacctatcccaaacgccgcggtctcacccgggtcaaggaattaaatgggcgatggtaacatgttagacgtcctccatgctggtttacacgcaactcaaatgatgggttatacagaaatcatgaatgcttaccgcttcattacccacaatggcgctcgggcaatgcacgtgactgaccaatacggccttgaagttgggaaacccgcccacttaatcttaatggctagtgataatttctataacgcaattaatcaacgggccgctgttacgctatcaatccacgctggtcgtattattagcgaaacacaaccggctaccactcagttatttatttaattaactagcatcagttgtgacggtttcgtctgggaaagttaatgtaaaggttgtcccttgatctggttcactttgaacctcgatggtcccatgatgtaattggaccagttgatgaacaattgctaagcccaaaccagattcaccgtattttgtgttcttccgggaaggatcagccttatagtaccgttcccaaatattcttaacttgctcaggggtcatcccaatcccagtatcactaaccgccagaatggtttcgtggaacccagcttctgcagtgaccgtgatttgcccgtcattggtaaattggatggcattttgcatgatattaaacataacctgaacaaagcggtcatagtcggcatagatagccacttcttcttgtgcttcaagcacaatggtgtcaccggcatccgccgcttttttctgaagttgttcttgaatattttgcaacgcttctaccgcattaaatgtttgttgattcaatttaatttggtttgttcgaatcttttcataatccaagttctcattaaccaagcgaattaagcgattcgtttcgttttgcattaatgaaatactcttttctcgcatttcttctgggatggcatcgtaggctaagccttccaatagccctttcaccgtcgttaatggcgtccgcatttcgtgtgcagcatcggccataaattgacgacggcgatcttcttgccgcttaatttcggcctcagattcattaagcgagtggaccatttcgttaaagtcggtcgccaaatcatccaattcatccttacctgggttatcaatatggacatcaaaatccccttcggcaaccagatgcgttgcatttcgtaagcggctaatccgataaatctggtagcgcgctagaacataactgagtaaaatcccaccaatcgttgaaagtaagaaggcaatcaataaattcttgcgcatcgtcactaagcccgacttaacgtttttaatagaggaaccaaccccaataacataaatcaacttatcattatagaaaaccggtttaaaaacaaccagttgatcttgatcattattaaattgccgggagtccttgctcatactgagtcgttggacctgccccttcttcaggtatttccagtactttttcttaacggaaacgttcgagttaggcgccgggtagaccatttcattttgcgcattaaaaaaattaaaactaacccgttgttgcgacaggatggcttggctatcgtcaataaactgcttggatagtgttacctgtgagccctgtttgaatgcttcacgttcaataactgatgcgtaaccttccaactgatcccacgtattattataagccgtctttgttgaatactgcgtaaacgcaattccaacgatcacgatggtcgtcataataaccccaaaaaaggctagcatccactgatagatcagtttcatttagtgtttattgaccgctgaatcatcaaatttgtagccgacaccccagaccgtctggatcacttggggaccaaccttttcgatcttttgacggagttttttaatatgggcatcgactgttcgttcatcaccaaaatattggtaatcccaaacaagttctaataactgttcgcgtgagaaaacttggcgtggattcttcgctaaagttttcaataaatcaaattctttgggcgtgagatctaaaatcggttcgtccattaaataggcctcgcgtgtcttagagctcatcttgaagtgatctgtttgcacatcataatcggagttatctacttcttcaacttgcgcatcttccgcaccaacttgttcatcaactaactcagcacggcgatgaagcgccttaatccgggcgatcaatgtaattgggctaaaaggtttcgtcacataatcatccgcacccaattcgagccccaagacttgatcactctctgaatcgcgagccgttaacataataatcggcaccactttagattgctcccgaattttttgggcgacctgcatcccatccattcctggtaaattcaaatctaacgtaataatatcccaactatcaggatcaacactaaattgttcaaccgcttcattaccatcatacgcaaagtgggcatcccacgcttctttttgaaagaacatgcccatcatttcagagacagacttattatcttcaaccattaatattttcatttgatcgaacacgaagcactttttttcaaaaacctgaagattcttcaagatttgaagttcatgatttatgaacgaacgtcacctgcaatcgattttcattgctttggtattctctatctcgaagttaatcaacaacagattgacctcgcagcggaatatcaggctttaaaaagcgatcattcattgggtgaaattgcccagacaatcatcaatcactatcagttatagttgacctataaaggacttgtattttttgatcttgacgggacactttacaatgaacactctcgcgtggacccagcagtcgccatcgctgttaaacaactacgcgccaaccattacctcccaatcatttctaccggccgttcaccacttgaaattcaagaggcattagcaattaccgggattgactcattcatcgcattaaacggtagttacattcaatttgaaggccaaccggtttaccaaggcactattccaactaagacgattgaacaagtggttacaattgctcaagaagctggcgaagcagttgccttttatgatgatcaagccattcgaattaccagtgttacacaagcagctaaagatgcttatgctgaagtcaacgcaccagtaccaagtgttgatccagaatattacttaaaccatccaatttatatgctgttaattttgacgaacgacaatgatgcggcttatgcaacagacgatttaacattctaccggaacacaccttattcaatcgatactgttgaaaagaacggttctaaacaaactggtattaagcggctacttgcttctcaaggattagaaggcatgccaacttatgcttttggtgacggtcgcaatgacatcccaatgcttagttacgttgattatccaacagccatgggcaacggcattccagaagctaaggcccaagctaaatacatcacatcagccaacgtagaaggtggcattattgaaggcttaagacactggaaattaatctaaatgtccaaacattctttatttgctaaaaagaaaatcgatgcaagtcaatttaaaaatggcttacttgaacgaaacttaacagcggtcggcttaaccgctatgggagttggcgccgttgtgggggccggtattttcatcacacccggaattattgcggctaaatatgccggtccaggggcaatgttatcttacttattagcggccgttgtttgtgcgctagcagccctttgttattctgaatttgcttctaccattccactagctggtagtgcctatacttacgtctacaccgtctttggcgaattagtcgcttggattttaggctgggcactggtttcagaatatctatttgcggttgcttcagttgcggttagttggtcagcttattttcaaaatttaatggccggctttgggcttcatttaccaactgctctttcagcagcgtgggaacctggtaagccagccggtgttaatttaattgccggaattgttgttttaattgtcggtttcttactctcaaatggtatgcgcgaatctacccggattaataccattatggtcggcgttaaaattgccgtcatcgtcattttccttggcgttgccattttctacgttaaaccagcaaacttccaaccattcctcccttatggtgcctcaggtgtcttatctggtgctgccctagccttttacgcttatattgggtttgacgctgtttcaacggcctctgaagaagttattaacccccaacgtgatatgccaatcgggattatcgcctcattgttaattgcttcattactatatgccgctgtcgcaacagtattagtaggggttgttcactatacaaaattaaacgttggtgatcctgtggctttcgcattacaattgatgcaccaaaactgggtggccggtattatctcattaggtgccgtcgcggggatgacaaccgttttactcgtgatgacttacggtggaacgcgtttaatcttcgcaatgagtcgtgatggtttattaccagccgtctttgccaagattaaccctaagacacacgtgccagttgccaatacctggatttttgcagtcgttaccagtatcgtggctgccctcgtaccgcttgataaaattgccgaattggttaacatcggcaccctctttgcctttgcaactgtctcattaggtgtgattttcttaagaagaattccaaactacaatgagttgcctcaaggcttcaaagtaccgctctatcctatcgtgccaatcctctcatgtatcctctgcgtcctcttaatgacgcaactgcaaatgacaacttggattgtctttgtcatctggctcgttatcggattggtgatttactttagttatagctatcaccatagtcaacaaagaatgtaattattttttatgttttttattcaaaatcttgtcgaacaagttgttgtcttgtgggttaactgagtccccactagccaccgcaaatgcttttaaggcatcacgttgtttgctgtttaaggactttggtgttaccacgttgactgtcactttttgatcaccattgcctgttccgtgaagtttaggcgcacccttaccacgtagacggaaaacagtgttcgtttgtgtaccagcaggaatcttcaacttaactggaccatggaccgtgttaacttcgatttcgtcccctaaagcggcttggacgaatgaaattggtacttcaacaaaaatctgagcaccatcacgttcgaactcatcactaggtgcaacgcggaagacgataaataggtccccataagggccaccatttgaaccggcttcaccttgaccttgaagacgcatttgttgtccatcttcaacaccggcagggactttcaccttaacggtatgacgttcttcttcgcgacctgtcccatgacaagtatcacattttgacttaatttccttaccagtcccaccacagacatcacatgtttcgcgtgacatcatacggccaagtggtgtttgacgttccacttggatttggccagcaccgtgacatttatgacacgtttcagcacttgtgccaggcttagcacctgaaccgtgacaagtatgacattcggcttcacggctgtaagaaatctttgtttccttaccaaagacagcttcttcaaacttcaagtccattcgatattgtaaatcagaaccttgacgtgggccattaggttgttgacgagccccgccaccgaagaatgaactgaagatatcgtcgaatccgccgaaaccttctgcgccaccgccgaagccaccaaagccttgaccagcaccagcgccgccaccaaaaccgccattcatgcccgcatgaccatattgatcataggctgctcgcttttgaggatcgcttaatgcttcgtatgcttcagttacttctttaaattttgcttctgcatcaggtgctttattgatatctggatgatattttttagaaagtttacgataggcttttttaatctcatcgtcagaagcgtcgcgtccgacacctaagacgtcgtaataatctcttttttcagccatttattctttgtcgtctttaacttcttcgaagtcgccgtcaacagtaccgtcatcagtcttagcatcagttgcgttaccttcagcaccaccagcagcttgttgtgcttcttgggcttgttgatataacttaactgtcaattcttgaacaatttcacttaacgcatcgcgttttgtcttcatgtcttcaagattgttttcttgttgtgctttaactaattcttctttagcatcttttgctttttgtaattcttcgtcagaaactttaccttcaagttctttcaaagtcttatctgtttggaagattaattgatcaacatcgttcttcaaatcaacttcttctttacgttttgtatctgcttcctcgttttcttgtgcttctttcatcatacgatcgatttcttcgtctgacaaaccagagttactcttgatagtgattttttgttccttgtttgtgccaagatctttagcagaaacgttaacaataccatttttatcaatatcaaacttaacttcgatttgtggcacaccacgaggtgcagcaggaatatctgttaattggaaacgacctaaagtcttgttgtcagcagccattggacgttcaccttgtaagacatggatgtctacggcaggttggttgtcagcagcagttgagaatgtttgggccttgcttgtaggaatagttgtattccggtcgattaacttcgtgaagacaccgcccattgtttcaatccctaatgataatggtgtgacatcaagtaaaacaacgtctttaacgtcacctgagataacgccaccttgaacagcagcaccaagtgcaacagcttcgtcagggttgattgagtgatcaggttctttgcctgtccagttcttaacagcttcttgaacagcaggaatccgtgttgaaccaccgtttaagatgactttgtcgatttcgtttgcatctaagccagcatctttcaaagcattcataactggtgcttttgtacgatcaactaagtctgatgttaaacgatcgaattcagtccgtgataatgtcatttctaaatgtaaaggaccattttcgccggctgagataaatggcaagctgatttgtgtgcttgatacacctgataaatctttcttagctttttcagcagcatcctttagacgttgcatagccatcttgtcttttgataagtcgataccattgtctgatttgaagttttcaactaaccagttcatgatagcttcatcaaaatcgtccccacctaaacgtgtatcaccatttgttgataatacttggaagacaccatcgcctaattcaagaacagaaacgtcaaaagtaccaccaccaaggtcataaactaagactttttcgtctgtttctgtcttgtccaaaccgtaagctaaagctgaagctgtgggttcgttgataatccgtttaacatctaaaccggcaatcttaccagcatctttagtagcttgacgttgtgaatcgttgaagtaagcaggtactgtgataacagcttctgtgacttcttcaccaagatagtcttcagcgaatttcttgatgtattgtaagatcattgctgaaacttcttgtggtgtgtatgatttgtcgccaacagttactttgtaacctgcttcgccaatgtgacgtttgattgatgcgattgtatctgggttagtgattgcttgacgtttagcaacttcaccaacttggatttcaccatttttgaatgatacaacagatggtgttgtacgagcgccttctggatttgtaataattttgggttgtccgccttctaatacggcaacagctgagtttgttgttcctaaatcaataccgattactttactcatttattgtgcaactacaaccattgctggtcgtaaaacgcggtccttcaaataatagcccttttggaagacttgaaccacggtgtcagctttttgatcaccatcaaccgcaaccgtttgaacggcttggtgaatggtcggatcaaaggcttgaccttgcgcctcaatttctttaacaccatggtcttctaaagcatgtttcatatgatcatatgtcatttgaacaccctttttaagaccttcatcagttgcttcagctgccaatgcgcgttctagattatctaaaacgggtaagacatctttggctaatgattggccatcatattttaacaagttagcttgttctttttgattgcgcatttggatgttcttaatttcagcttgtgaccgtaagaaactatcttccatagcgtcatatttcttttgaagttcagctaatttatcatctgcttcttcaacaggtgcttgtgcttcaattgtttcttcaacttcatcagcttccataactggttcaaatggtgtttcttttttaggcgtttcttctacagtttcttcagttggcttttcttggttttcagccttttcttgctttgtcaattaagattgactatcatcaaaatctgcataataatcaattagtttcttcgctaattcttcgcggaataaatcgagtaacccgatcatgcgcgaatatggcatgctagtgggacctaataaagcaatcaatccttggccgtgttcaccaacatcataattaacagtcattaaactgtaattcttcaataaatcattggtcatttcatcgcccaaacgaacctgaacttggctattggcctcacccggtgataactctagcaacttggctagatcgtccgattgattaatgatgttgtagattgacttcaactgtgacacatccgtcaattctgagaagtttaataagttcgattggccccccacatataaacgttcctgcgaggcctgttttaagacatcatcgaagatgtttaaaaagccgcccggtgagcccatgtattgcattaataacgcaggcacctctgttttcaacttctgactgacaacggtcagcggcaatccgattagatgatcattcacgactcgaatcgctttttcaagttcatcacctgaaatcgcgtttggaattgtgaaaacctgattatcaaccgttccggcacttgtcacgataatcgccattacctggtgattaccaagtggcacaagtcggaaacctgtcaaccgaatctctgccatctccggtcctaacgtaatcgctgtatagctcgttaggtttgaaagaatattggcagattgtgaaacaatctcgtcaatcttatgataatggcgtccaaatgattgttgcacagtcgcaacatccattggatttaagacagcgggctgaatgagatgatctaaatagtaacgatagcccttcatagaaggaacacgtccagaagacgaatgcgtcttctctattaaaccgacattctcaagatcagccatatcatttcggattgtcgcggaactaacgtgcattggtagttcagacattagcttcttagaacccaccggctgaccactctcggtaaaaagacgaataatttctttcaaaatcattaattgtctttcggtcagcatctatcgataattctcgtgaaattgttgtaaatcagcgactgaatgactcgctaatattgattgggctgcttggactttttcaattggccagtggtaccaatcaattgcttgcagggtttcaatgtcagctggtgtaaaccgtgactttaaaatccgtgctggattaccaccaacgacagcgtacgctggcacatccttaaccaccaccgcaccggcagcgataatcgcgccctgcccaatatgaacaccaggcatgattaacgcgcgcattccaagccacgcaccgtcttcaatgattgtatcgcccttgggctcataagaggccgcaatttgttctgggaacggataggcgctaatccaatcactgtgatgattatgattaccgcccatcaaaataacaacgccactggcaatgcaaacgtaacggccaataattaggcggtccaattgccaaccaaattcagtctgtggattaaataaggcgcgtgaggcatcatcgccccaatgatatcgaacgcagccgtcctcaaaattctggtgatcataataccccgaaaagtaagaataatcgccgacttcaattaatgggtttgtcaccaaatcctttaaatattttgtttctgaccaatgttgataagtattcttgtccatttagtagctgtctaacaagaattcctggaagacttcgttgcctaggaactttcctgattcagttagtcttagccagtcgccttcttgttttaggtaccctttttcaatctgattggcgactgtttcgccgtagatattctgtagtgggtatctgaatttttcttcaaagtgcttgattgagacaccttgcattgtccgaagccctaagaagagttcttcttccatttgttcggtcaagggaagcacgtggcgttcgatcactggcactttatgtgcttgtagcggctctaagtattgttggattgggccaaaattgtggtagcggtccttgcccagatagccataagcaccagccccaaagccgaaatacttttcattccgccaataggttaagttatgtgcagactggtagcctggtttggcaaaattactaatttcgtattgttctaaaccagcttgttggaaactatcaatcgcattttggtacatgtgtgcttcaacatcttgcgatggtaagcgtaacttaccctgacgcatcaaattatagaaaatagtcttcttctctaaaattaatgaataagttgaataatgcggcaagtcaagatcgattgcctgtttcaaactatccataaaatctgcttcactttgttgcggtagtcggaaaatcaaatcaatactgatattttcaaaacccacttgacgcgcattagcaatggcccgataaacgtcagcactacgatgaatccggccaatcttcttcagaatgtcatcattaaaagactgcacaccaatactcaagcgattgacgccattgtcttttagtacctgtaatttagcggtatcttgtaaatcattggggttggcttcaaacgtaaactcgccaccctcataaggtaagtactgatgaatgccatccaacaaacgttggagttgggctggtgagagtgtcgttggtgtcccaccgccgacataaattgtttcaattttctcgtctgggtattccgccattaccaattggaattcgcgaattaacatgtcaacgtactcatcaaccggttgcccttcaatgaagaccttgttgaagtcgcagtaataacaaatatgttcgcaaaacggaatatgaatatatgcgcctgccatttaatgttgaccctctaatttctcaaaataagtccgggtatcagcttcatcttggtggagttggtcaatcaacgcttccgccgaatcaaacttcacttcacctcttaaatactgataccactcaactttaacttgttcaccataaatgtccgcactaaagtcgagtaagttaatctcaactgtcacgggattattggcgtggaacgttacgttccggccaattgacgccatcccccagtaccattggccgcgaaccaataagcggaccgcataaatcccaatgcctggtaaacgttccggtttttgactttcaatattagccgttggaaagccgagttcccgcccccgtgcttcaccatggacaacttccccagtcgtttggtaaacataacctaacaactcgttagctgccgctacttgaccttgatccaaattttcacgaatcaaagttgagccaatcttatgaccttgataatcgtgttcagccaccgtcacgatttcaaaacggtctttggcatacgtgctaagggtctgcatattagcgatgtcttttttaccataggtgtaatcaaacccagcgaccaccgttttcgcgtggagcgccactaagtattgatcgacgaaatcttggggtgccaacttggcaaagccatcgttaaaatggacaacatataaaatatcgacacctaaatcagccattaattcttgcttccgttcaactgtcgataaataacgaaaatcggcttgattgacatttcggtaaacaatcgcaggatgaatatcgaaggtcatcactgccaatggtcggttctgttgcaccgccaattctttagccgtcttaatcactgcttgatgggcccggtggacaccatcaaaaaagccgagtgctaagacaatttcttcggctggtacttgttcttttgaatagggatggattaattcaatcacacgcatttaatgagtcccttggttttgtaaatacattttatatggtctatagagatgttgttttgcgttagccacttggtacaaggccttgatgtgcccctcgtaagttaaggctaaaatctcttctgtttgttctgggaacgttaagaagacaccgtttaaaattttggcccattgatcatcatcaagcgcaaccttgacgttttcttcaaaaacatgatctaacggaatcaaaatatccgctaattgaccgttatcagcagcttcagctagttgtgccaaggtaacgcaactgccgatttgaatgccaccactcttaagacgcgttaaatcagacataactgccggtaagcctaacttacggccgaaatcgacagctaaagtccgaatataagtcccttttgaacagcccgcaataaagcggaatgtttggcgacccgtttttgcatcgaattctggttcgccttgcaagtcaaattgcgtaattgtaattttgcgttgtgggcgttccacaggatcgccggcccgtgcataatcgtatagacggcgcccgttaacttttacggctgagaacatcggtggaatctggattgaatcccctagaaaactggccagtgtttctttaattttttcagttgaaattggttcagctaaccgttgttcttcaacgacttcaccatctaaatcttcggttgtcgttgataaacctaacgtaatttcaccggtataaactttaccagagtgcaccaattggtccactaccttggttgcttggccaatacagattggcaaaacaccatctacattgggatcaagcgttccagaatgccccacttttttcatatgaagaatccgtcgtactttaaaaacgcaatcgttgctagtcatgccgcgttctttatataagggtataatgccgtccatttattttatgaaggtaatttctttattttgaagccgactatcgatccgggcactttctaattcaatagcaaaaataatttctctttccttttctgccttagagagactctccatatagcccggtacctgtgcttgataagcagccgctacatcactaaaactatactgggtgcggtataccttgagccgattgctggtaatcctcaacccctcactcgtgggtagcgtataaattgcagctcggcctagatccagttcactcactttcggtgcttctgggtccgttccaaaataccaaatattagggacatcattgagcgtaacaaaactaatctgtcgactagatggctgtccctgttcgtccgccgtacttagcaggattgtattaaattgcttaacgtaattgcgaaacgcatttaagttattctgatatgtctctgaactagctgtttgattatcaatataagcaatcgcatcgtcaattgtctctaacgccggattggcttctaaatagtaaagaatttggggaataatttgtgatatttctcgttgatgataataaaactgcaaccaccgattagaggctgataacgcatctgtataacgcttatccagctgtctatgatgtcgttgaacaatattttttaatggacgctgtttaatcagtttttgaaagattgctaaactcagtagaaacattacgattgcaactaaaatattaattttaacaatccccatcattggccagccttcatatgccatcaggcaatcatataagattactaaaaaaatggtcaacacagccgcacaaacaatcactaagcggcgtttaaaaacccgccgtttatgggtcatcgcttcaattattttttgccgctctttcatagttcgttcgcgggcaatcatctcatctatgacagcttgatcttcattagaaatcatttagaaatcatcgttttccccctcaaaagcatcaaagcgctgacgtaactcataagtcccaacatcggcaaaatcgggaataatgatattttggcgctgcttacgcatgcttgctgcaccatatttagcagtatacatttcttcagcccaggctaatcgcttctgcaaccgctgttcatcaaacgttttagcgataccctttctaatccgatactgttttactttattcattaaatagagactgataaagaaaactgaaaaaacgataatatagcgcaagaagatataattcgtattctgtaataattgtttaaaggcggcccgattaaccggaatgattgtttcacgggttagatagataccgactgttgccgcggtgggaatcagacacatgacccagccaataccaatcaacactaattgacgcaaacgatgaccagtctttttagacgtaaaaaaccaatcgattgtaatctgatcttcacttaattgatgacgaatataatctggtttactcatttactcatctgaatcctccccttctcgttttccggttgcttctgtcgaacgtgtcggtgatttccaaaccccagcatctttgccccggataatttggcgaatcgttggcacaatctcgaccgctacggtatacgtattaaccatccaataaatcaagatataccaaggtgcaaaggcgatatacttcaacgaacggcccccatcattaaaataggaggcttgcaccaattgaattaatccgaccaatatttcaatcgtgataaaaattgctgcaatagacaaactcgaaaggagtcggtgccaatcctgattaattacgtaaccaatttgaaggacaataaaagtcgccatactgatccaataaaataacgaccaaatgatactcaaaccataatcaatgataatcgggaccatcgaaaagtgcttaattgggtgccgtaaaataccaaacgatttcgtcaagagcacgtagatcccgccagaggtccatcttcgccgctgcttaacgagttccggcagtgtttctggcacatccataaaaaaacgaatgtgcggtgcaaaataagcttgccagcctgcggtctgcatatcccatgaaatcgcaatatcttcagtcggttgttctgcttgccaaccaccaacatcaatcactgctgccttgcggtacatcgtattagccccagaaaaggcaaacaatccaccataagaaagctgcgagcgtttaattaagccaatgattgaattcaattcattttgctgggcttctgccactagagttgtcttattaatcgacaacatattgccggtcacagcacctaattgactgccaccttcccgttcgaaataatacatatacttccataaggcatcaacttctggtttggaatcagcatcattggacaaaataaattcgcctttggcaaatcctaaagcactattaaagccggctgccttgccccgattattaataatcgtgaccgttcgtaaccgttgaccgtattttgcttgtaatgtttctaaaataatcccagttttgtccgtcgagccatcattgacaacaattatttcatattgatcggttggataattcatttgggttgctaaatgatcaatcgtagcttcaattgaggcttcttcgttatgtgccggcactaaaatcgtgatgaacggcgtccctttttttagataatgaggttgatcttccttctccattaatagccaataatacaaactagaaacaataaacgataaccccccgataatcggataagaaaccagtgtgtagattaatatttgggtgaaatagtctatcaatagcatctaacgctgtgcttcatcttgatgtaacttacgcaataattcgtcgatatgttcaccataacgaactgaaccatcttgttcaaaggtaatttctggaatcttgtataacttaattcgttggccaagttcgctacgaatcaagcctttagctttatccaaacctttttgtgctttttcagcatcactggctagattagacaagatactgtaataaaccttcacgtgttgtaagtcaccactcagattaatatctgtaatcgttactccttcaactcggggatcacgtacacgttttaataaaatatcattaacttcacgttgaatttcttgttcaacacgaccgacacgatgtttcatttatttaacaggtacttcttccatcacgtaggcttcaatttgatcatcaatcttgatatcattgtaatcttcgattgtcacaccacattcaaagccggttttaacttctttaacgtcatctttgaaacgtttcaagcttgaaagtttaccttcataaatcacgatactatcacgaatcaagcggacaccactatcacgttggataacaccagtatcaacgatacaaccggcaattgtcccgatcttagaaacattatatgtttcacgaacagttaattgacctgttactttttcttcgtaaactggttctaacatacccttcatagcagcttcgatttcttcgattgccttgtagatgattcggtgtaaacgaatatcaacttgttcagcatcggcttggatcttagcttgtggtgtaggacgaacgttgaaaccgataatgatagcgttacttgcagcagctaatgtgacatcactttcgttaatcgcaccaacggcttcatgaataatattcacgcgaacgccttcgacttcaatcttccgtaaactaccagccaaggcttctgttgaaccttgaacgtcggctttgataataacgccaacttcttttaattcaccttgtttcattgtttcaaacaagttatctaatgtgacagggtttgaacggctacgttccttcaagagggcccgtttagcacgttcttcaccagcagcacgagctgttttttcgtcttcaaagacaacgaaacgatcagctgcttgtggcacatcatttaacccagtaatttcaactggttctgatgggaagacttctttaacacgacgaccgcgatcatttgtcatgacacggacacgaccaaaggtattcccaacaacgattggatcaccgatccgtaatgtcccttgttgtactaataatgaggcaacaggtcccttacctttatcaaggcgggcttcaataactgtcccaaccgctttttgatcacggttagccttcaattcaagcacgtcggcttcaagaagaaccatttcaagcaagtcatcaatgttttcaccagttttagctgagatcttaacaaagattgtatcgccaccccagtcttcaggaacaaggccgtaacccattaattgttccatcacgtggtcagggttagcacctggtttatcgatcttattaaccgcaacgataattggggctttagcagccttcgcatggttaatagcttcgattgtttgtggcatcacaccatcatcagcagcgacaactaagatgatgatatcagtaatatcagcaccacgtgcacgcatgttagtgaaggccgcatgtcctggtgtatccaagaacgtgattaaacgatcgtttaacttcgtttggtaagcaccgatatgttgtgtaatcccgccggcttcaccatcagtaacgtgactgttacgaaggttatccaataatgttgtcttaccatgatcaacgtgacccatgattgtgacaactggtgggcggctcacaaggttagcatcactcttagcttctgtttcaaagactgaatcaatatcagcgatatccacttcaactttttgttctgcttcgataccgtaatcagttgctaataattcgatcgtatccttatcaagtgattggttcatgttaaccataatgcctaacatgaataacttcttgataatttcagctggttcgcgatgaatcttcttagcgatatccgcaacgttcatcccttcagagaaaactaatacttctggtaatggacgttctttacgttgtggcatttccttcttagctgcgttttgttcagctaattgttgcttacgtgtcttcttacgtttcttattgaaacgttgttggctattgccgtagctgttatagccaccgccacgttttttatctgggccaaagttctttggcttgcttgctgtattgtttgatgctggtttagaagcactaacagtattagcttgcattttttgttgcatttcttgtgcagaaactggccgtgatggtgtcgttgctggacgactgtttgttggtcggttattcgtcgtattaggacgtgcactattgttattgtttggacggctgctacctaatgggcgaccatcttttgtaacggttggtcgtggactgttagtcgttggacgtgcaccgtttgttggtttgccgtttgatgggcggttgtttgaagcattgtttcttgttggacgtggacgacttgcttgttcacgacgcttcttttcgtctgcttcacgttgttcacgttgttgttgaatccgttcttgggttctttgacgacgtgcattagcctgtgaaatctgttcttgtaagctcattggatggttagcgcttgttgaacgattttggctattgttatttggccgactgtttgtgttaggacggctgttattaggacgagcgctattgttgttaggacgcgcattgtttgtccggttttgaccattgcttgcttgaccattacggttagcattagcttgtggtcggttgtttgaatgttgcgctggttttttgtcggcttctgggcggcgacggatagcagttttattgatcttgatcttaccactttctgatttttcgctcgctttaggtgcggcaggtgttgctggtttacttgcagctggtgttgcttttgtttggaaagcagcccgcaatgttttttcttgattatcatcaattgttgccatgtgattcttgagatcatagccttttttgttggcagtctctaaaatgtctttgctagcaacattaatttctttagctaattcatagatacgttttttacccatttatcccagtagcgttatcatctttttggcaaacccagcgtcgacaaccgctatggtggctctatgtaatccaattgcttgggttagttgggccgcggtgtaggcctttgtttctgggattttgtagaaatgactcttatcagtcaatttcttctgcgtcagtggactgatatcctggccgataaaaaccaatttagcttttgactgctgaatggcttttaggacctgttcttcaccactgaccagttgccttgctctcatacaaatgcctaagagttgcaataaacggtctggttgttcactcattcattttcgttctccaaatagttcttgacgggccttttgatggtcaacatactcgaacaattctgtgtaaaagtctgctgaaacatcaatgccaaaagtcttttctaagattttcttagcttgcgctgtcttaatcgcatctggttctaatgaaacataggcaccgcgaccagatttcttaccagtcggatcgatactaatttcgctttcagcggttttaacaattcgcaccatttcttttttaggcttcatttcttgtgaaataacgtcttttctcattggtacttttctttgtttcatcatttattcttgtggttgttcttcagaatcaacaacagtttctgctggttgttcgatgtcttcagcaacttctgccgcttcaggggctactgcaactgtttcttcagtagtctctggtgtgattgtttcttcttcgaaaccttcaaccacggctgattcatcttcactatcatcgccatcgacaaattcgacttctgattcaggtttgatgtcgatcttgtaacctgttaacttagcagctaaacgggcattttgaccttttttaccgattgccaatgacaattgataatcagggacgattaccgtacatgtatgttcgttgccatcattaaattgaacagcgatgacttcggctgggttcaaggcatttgcgatgtagtctgaaggatcttcttcccacttcacaatatccatgttttcgccgtgtaattcattaacgactaattgaacccgttgccccttaggaccaacacatgttccgactggatccacgttaggatctgttgaacgaactgccatcttagtccggtcgccagcttctcttgcgattgacacaatttcaactgttccgtcataaatttctggcacttcttgttcaaataaacgttttaccaaatcagggtgtgtccgactaacaaagacttgagggcctttagttgtgttttccactttagaaacataaaccttgatccggtcatgtgcgttatacacttcgttagggatttgatcttgcttacttaaaacagcttcaatcttacctaagttgacgtagataaacttgttatcgcgacgttcaacaatcccttgcataatttcgttttcgtattggctgtattcgttgtaaataatacttctttcagcttcgcgaacccgttgcataataacttgcttagcagtttgggcggcaatccgaccaaaatccttaggtgtcacttcaaaacgaattgtatcgccaacttcatatgctttgttaatttctaaagcatcttgatagctaacttccaaacgtgaatcgaaaacttcatcagtcacttctttgacagcataaacgtggatgttacccttcttttgatcgaattcaacttccacattttgagcttgaccgtagtttcgtttataagccgaaacaagcgctgcttcaagtgcttcaatgacgatttctttcttaacacctttttcttgttctagcgcatctagggcgcctaacatttccttgctcatctaaaattcaattgctaagcgagctttggcaatttccttgcgattaaatgtcacttctttttgacgcgttttaattttaatggctaatgttaaggtctcttgatcaagcgcctttaatattccttgataaatcttctcgccatcaacggcttgatataacgagatatgaatgtattcgccaagtgcattttgaaaatctgcttccttcttcaaaggacgctctgcaccaggtgatgaaacatctaagaaataagcctgcggaattggatccgggtcgattgaatccagtttctcacttaacgcatcgttaactaaggcacaatcttcaaggtcaatgccgtttggtttatcaatgaagacacgtagataccagctactaccttctttaacaaattcaacgtcgactagctcaaaatggtgttgatctagtatcggcacgagtagatcatgaactgtttccacaacggtactcaattaattttcagtggttgcgacgctattttgcgtcttacctgtcgtcaagatttcatggaagttttcaaaactaatttcgaccatgttcttgagggcttcgtcagtattcgaaccaacgtgtggtgtcaacaagacgcgtgggtataaatcaattaattcttgggttgtcgcatcaggaactggttggtctgctggaaattgtttgaagaagatttcgccttcagctggtaatacgtcagcggcaaatgcgccaagttgatcagctttcaaagcatcgataatcgcacggttatcttgcaattgcccccgagctgtattgaccaagatggcatcattcttcattttcgcgattaaatcagcgttgataaattgatcgttttgaccagcaaagtatggaatatgcaagctgacaatatcactttgcgccaataattcatccaagctaacaaaatcaaggacttccttagcaatttctgatgggtacaagtcataccccactaccttggcacctaagcctttgtatagctttgcttcggtatagccaatcttaccagtaccgataatcccaaccgtacagttgcggacttctttactaaacatcactgggctcacacgaaaatcatgatgtgccgttcgattcgtcgtgtaagtggtatggcgcaataatgacatccctaacgtcaaggctaattcagcaatcgcatttggtgagtaggctggtacgcgagcaacttccatattgtacttgcctgctgcggctaaatcgatatgaccatagccgactgtccgcgtaaagacataatggatgccatattcattcaacttcgccagattttgtgcatcagcggcacagttagcacgtaacaataccgcgtcatggcctttagctgtttcgatattagcgtgtgttaatagttcttcaattaaggttaaatcataatcatagttattatattcattaaacgtcgccacttcattggggcgtacgccgtaacaagcaattttaaacatctagaaaataccgatttggttgattacttctaaaatcactaaccagactggcgtcatcacaacggctaatactgttgataataatgacgcattcgacgccaagaccgcatccttatcaaaactaatcgcataagcagcggcaactgttgccgttggcgttgccatcatgatgacgattgttgccaaactgatgtagctcactggtaaaacgtgtgtcattgttaggattgctaatagcacgatgtttaaggcaggcactaaaatgactttgttaatactgtaaatccatgaggtcttgtctgaagcagcttctttgaaactgatttcgccaagcgttgtcccaattgctaaccaagctaacggtgaacataagccggctaagtaagtcattggtttgaacaaccatggtgctgtttgatcaattcgtaagaaagcaactgaatggcccgcaactgctacttgtggtaatgcgccttggattaaccagatgattaacccagcaaatgtcgcgatgacgattggatttaagaacatatttttcaagttcttcgattccatcttcaagccgctcatcttgatgtatccatatgagtataggaaaacacggtacccaatgttgaaaattgagctatacatcacccctttagccccgaaaaccgccccaacaattggaatcccaaagaatgttgttgaaccaaagattgtcaaaacacgtaatgtatcttgttgatcccctttaaagcgtaagtataaaggtttcgtaattaaaattaaaataatatagattaagaagccccaaactaaaacgttgatgccttcttttaaagtcttaccattaatgtcttgcatgaatgagttgaatgctaatgctggtaaagcaaccgttaaaacgacttttgacagaatcttcccaaatttatccgtgaaaatctcgcgtttgcggcagtagaatcctaataaaataataaacactgtcgacgtgattgaactcacaatatccatgttcgtaaacgtcttcgttaaaatatcgccaatactcatatgctatatattaattatctaaacttccgagaagattttcccatacccagacaaagcatcttcaacatgtcgcttaacaagatttatcccgcacttgtgcaaaaagcagaacgtaaaaatcgtacccaagccgaagtcaatcagattatctgctggttaaccagctactcacaaagcgacctcgatacccaacttgcaaaagacatcacctatcaaacgttcttcgaagaagcaccgcagatgaatcctaattgcgctctaatcactggtgtggtttgcggcgtcctcgttgaggacattgaagacccgctgatgcagaagattcgctggttggatgaattggctaaggggaaatcaatggagaaaatattacggtcataactattccttaggtgctgggtatttctccgcattcttcactaatttcttagcaatgatatcatcaatatcgaggttcaaattgtcagccatcatatagctatagattaacacatcggctaattcttctttcacgcgttcaatatcttgaacgccttcttctgctgtcttccattggaatagttccaataattcagaagcctctagtgagattgataatgccaaatccttttcattatggaatggtcgccaatgacgcgcatcccgaaattggttaatctttgtcatactactttctgtcatctactttctgtcatttaataacgctcctttttttaaagccgctcttaattcatcatctacagcatatagatatagtccgtttacgccacgtgatagtagcacgtttagttcatttctcaacatttcttctgaaacatcaactttagaaccatcttttagagaccgacgctgttttgctttattgttctcacttgctgctttatcaaacacaatccgaccatttcgatatttaactgatggtccaataatgacacctgcataatttaaatcaaagccttgaatcgtaaaggtcgaaccaacttcaccaatcgtttgtggttgctcagcccaagctaattttttattctgctttttctgtactttatctactggtaattgtaaattccatggcatctgccaatcaccaattttaacgtaccaaggatggtcaccgtcttttttaccgttgatgtacttccagtcaaacgtcgctaaaagacgtgaaataccaaaattctcatctcgagccttatcttcaattgccttttgtaatactgccggtgaatcaaaaagtttaatttcataatttttctcatcattttgtggcagtggtttaactatctgttcatcaattagactacgaatccaagcgattgtttctctaccagcattaattcgtaactgcttttttaaactaattagattcccttgattttcgacatctgccaataaactattaagctggtcaggttcccagtattgttcccgtgatagtatttgctttttatcaaagacggcaaccaccacccgtgcacgttttaataaatcattcagttgattttgccccgtatatgattgcttaccttgcgttaataataagtgagcttcatcaacaataacaacatcaacaggattatcttcggagtagcgattaataaatcgtgttggcttcaggaccgtttcttgttttcccagtttgaaaatttctaacttctgcgcaatttcttcataaaccttcaactgctgatcatgattaactaacaaaaattgacttgtatttcttaggataggattttcagattcatccttcgctaactgattcaactcataaaataaactactcatcagaactgttttcccagaaccagcatctccttcaaccacaatcaactgacctttatttgttttactcgttaaattagcttcaatggttgccataattctgtcttttgcatctaactgctcatcagtcaatttatgaaatggcgatgctttaaataacgccgaatccctgattgttctttccaatggaaaaagacgtttatcaaactttcttaacttacgccaaattttagaaaagattttttccatttcatcatgagagtaatataggttttgctgattagtacgtcgattattaacctttttcacaacgtcaacactggccatatattgcatcattttattttcaatatctaatgtcattgatttattaaaatgttcgtgaccgatgatgtacatctctgaggttttagaatcagctaattcgcgccaatctgctctttctttcgaatcaatgctaatatgctcaattgtccgccgtttaatatcacttgtttcaccgacataaacagaataattcaactgtttgtcagcatctttgacaatataaacagttggataactcaaaatgtacttcttatcctcttccttaatgatatcttggtcgataatttctttttcgtaattcatttcatatatgattggtttcaaatgcggcatttacttgctatatttagcatcatattgattaaaaatatacgcaaatagatttgtctttgacgatttaacattagttatttcaactttactatttgttttacctaaaaaatcattgataaattgtcttttccctatatttaataaatccttctttgaagcaatattatagctccctcgattttcaaaaataagtatatttcgtattatgctgttgagatttgattttttgatttttgttttatctttttcaggcgtatctttttctctatctttaacataattagcaaaattattatactctaacgaatatctattccaaccttcatttcccaattttcttattccatacttacttaaattcattttagattcttcatcaaagggtactgactgctgttgaattagcgaatttatgttctcatcagttataaagcgtactggatatccaaatgtttcgatcacgtcattacttgaataagttaattccacatatatattattaaaaataaatattacagctattgttccgttaataccaagtttaaaaatactaattttattttcaaactgagaacttctcatatttaactcatccacatagccttttaaaaatattgtatcttttataattgatgccgaatctgtattgagtaagcccttgttttcttgtacgattcttcttaccctagaaacatcgcttttagattgctttatttccaatctgtaaagtaaatctctagataacccatccaagttctccatttttacatcattatttttaatcattctaccaagtcgctcaattttttcgttcagaacctcaagattactttgaagtatactgccttccaagtagtttttgtataccttttttatatcagatctaagtctatgttcaaaatctaatatatctttagtcacttcgaatttcgagccatcgcttggtaaatgatacatcaaattatcgagttccttaaaatccctcttaaattctttatctctccaatatcgtttaccagtcagcgttgttcgtaatgcagggtcttcatttaaaacatgcccacaacaatcactgccaataaaaagttcatttttatttttaatattatatacatgaaacacactttttttaagagttgtattacataaattgcacttttggttttttccagcataatctttcttaatactaagctcaaatttttgcttatgacgtctccactcagacatacattgttttaaccattcatgtctattaatgctaatagaatactgctctgccactggcaagttctctagttgttgatcatccctaatgtaacctaatattctattcaagtccggcgtagctttcatgaattcactttttaacatcatgttagcatctttttcttgcatgatttttgtcaattacatcatatcaaacaacgacaattgattttcatctggtaaatcatttaagacgttattttctgttaaatattcaatcaatgtttttgagactttcccacggttagataagtcttctttggataagaaaggtttttcttcgcgggcggagacgatttgcttagcaacgttatcgccaagacttggtacggcgcggaatggtgcgagtaaggtatggtcgtcttggatcaagaaatcagatgaatctgatttttcgatgtcgaccatcttaatcgtgataccgcgttccaaacattcattggcgatttcaagaacggttaacaagttcttttctttcgtgctggcttccatccctttatccgtgatttccttcatgcgcgccttgacgccttctttaccttgggccatcgccacaaggtcgaagtcactggcccgcacactgaagtaagcacagtaataaataatggggaagtacactttgaaataggcaatccggagcgccatcaagatataggcggtcgcatgggctttcgggaacatatatttaatcttgagacaagaatcaatataccaatccggcacgttttcattatcgcgcatggcttgttgccaatcatccggaatccctttccctttacggacgcgttccataatgttgaaggacatactatcatccattccccagtgaattaaatccatcatgatattatcacgacaaccgataacgtctttcagggtgacaacgcctttattaatcaattcttcggcattccccaaccacacatcggtcccatgagaaaggccagaaatttggagtagttctgagaaggttgttggatgtgtttcttccaacattccgcgaacaaaacgcgttccgaattctggcacgcccaaggtgcccatcttcgaattaatctgttcaggcgtcacgccgagtgaatcagtgccggagaacaaggccatcacgcccggatcatcagtggggattgatttaggatcaatcccagagaggtcttggagcatccgaatcatcgtgggatcatcatgacccaggatatcgagcttcaagatattatcatggatcgaatggaaatcaaaatgggttgtcttccaagcggcatcttgatcatcggccgggaattggattggcgtgaaatcatagatatccatgtaatcaggcacaacgataatcccagctggatgttggccggtcgtccgtttaacaccggttgacccttttgccaaccgatcgacttcagccccacggaaagtttgttccgtatcacgttcataggctttaacataaccgtacgccgttttatcagcgaccgtcccgattgtcccggcccggaacacgttattttcaccgaacaagaccttcgtatagttatgggcgactggttgataatcaccggagaagttcaaatcaatatccggcaccttatccccgtggaagccaaggaaagtttcgaacggaatatcatggccgtccttatcaagtggcgtgccacattcaggacaatttttgtccgctaaatcgtaacccgaaccaacttcccctttggtaaagaattcggaatagtgacagttagaacaccgataatgcggtggtaacgggttaacttcggtgatcccagtcatggttgcgactaaactcgaaccgacagacccccgggaaccaaccaagtacccatccttgccactcttataaaccaatttttgagaaatcaggtaaataacggagaatccattcccgatgatactcttcaattcctttttcaaacgggcttcgacgatttcaggtaactcagcaccgtacaattcgtgcgctcggttcatcgttaaggtttgaatttcgtcttcggcgccagccatcttaggcgtgtaaagtttatctttaaccggtacaatttcgtcgatttgatcggcaatcttttgcggattggctacgactaattcttgcgctaattctggtcccaggaagtcaaaggccgtcagcatttcatcagttgagcggaaatgaacatctggtaacttcgaacggttcaaggggttggccccgcccattgagtgaatcagaatcttccgataaatcgcgtcttctggattcaaataatgtgcatcgccagttgcgacaactggtttgttgagtttttcgccaactttaactaagttgcgaatgatttcttcaagcgcctgattgtcgcgcaccaattcacgttccaataatggcgcgtaaaccgctttgggcatcacttcgatataatcgtagtatttagcacgatcgagcgcttcgttataccctttttgcatcattgcttcaaagacttcgccattactgcaggcggaaccgactaaaatcccttcgcgcaaagcatcaagtttactcttaggcaagcgcggtgtccggtaataatattcggtcattgaggctgaaaccaatttgaacaagttcttcaaaccggcttgggtttgtgccattaagaccgcatgtgctgggcgggcttgtttgtaaaactcgccgaccccgacgcgatcatttagttgattgacgttcaccatatcgtaattttcagcggcttctttttccaacttatacaataaataaccagttgattcagcatcggcattagctcgatgatggtgttctaggttgatcttgtagcgcttggtcaatgaatccaacttatgattcttgtattcaggatgcaacatccgcgataattccaaggtatcaatgactgggttatcgatcaggtcaatatcgttccgttcataacccgcgttcaagaagcccatatcgaaactaacgttatgaccggctaagacggcatcgccagtgaattccttgaacattgccaagacctcggcttccttcttggcaccgtggaccatttcgttggtgatgctggtcaattgcgttgtgaaggctgatagtggtcgctctggatcgataaattcatcgaacgaggcgacaacttcaccatcgcgcattttgaccgcagctaattcgataattgaatcgtaaacggctgacaaaccagtcgtttccacatcaaaaattacgtattcggctgattctagaacttggtcgcgcaagttataaacgactggcgtgccatcgttgaccaagttgacttcgacgccgtataaaatcttaacgccgtttttcttcccagcggcataagcatccggaaaggcttggagattatagtgatcggtcacggcaatcgcaggttggccccacttagcggcttgtttgacgtaatcgccgattgggttggtcgcgtccatttgagacatgttggtatgcaaatgcatttcgattcgcttaccatcagtcgctgtatcttcacgtttaggatgactaacttcgactaaatcgttgacgttaactgttaaatcacgcatgaagttatcttcttggacactcccgcgaaccttaaaccacatccccttatcaatcgcggcgaataaactttcatcgctagcatctcttgagaacttcttaaccgtaaatgaggatgagtaatcagtcatcttcaagattaacaattggcggccagaacggagtacccggacttctttatcaaagataaaaccttcaatcacgattgagcgttcctcttcagtgatactaatcatctgacgaactggttcagctggattaatgccacgacccatcacgattgggccatcaactggcttgccttcggttttacgtttttctttgagcgcttcgtttttcttaatcgcttcggcagcggcttgcgcgcgttcagcatcttgcaccgcccgttttgcttggaaatcttcgattgatttttgggaagctgattcgtcgattaatggttgaatcgcaaagttggggaagcccaggcgtttatagccggcttgaatcgtcgtttgcgcttgattgatgaaaaaggttttaacaatgtcattttcaacaaccaacaagactttgcgtccttcaatatagggcgtttccttggcacataattcatgcaagagtgacgattgaatcccactatgattaacgacgtattcccaataagcggctaaaacaccaccatcaagttctttagcatcggtactgatttcaattgaaacggccgcaatcgcttgaaaagccgcttctaaatgttcttcaaatgctgtgtaaaccgcaaagggtaacacgttatcgaagtgtaatttaaaggtccaccgttttgacgtttcgtggacaatcacttgttcgacctgccccgttttaaagccgggatagtgcgcgacatccgcaggtaaagcaatctgttctaataatttttgaaacaatgcggtttgatctaatgccacttatttttctgaggctaacaaaatgctgagggaattgattaattcatccttcttcacttctaatgtttcgcctgttttacgtaatttaacttcgacgatttcttcggcagctttcttacccactgtgattcggattggtaacccaatcaaatcgctatcggcaaacttaacgccagcacgttctttacgatcgtcgactaagactgaataaccagcttcttctaataaatcttcgatttgttcagccaattcaacttgtgcatcatccttaacgttcactgggacaacatgtaagtcatatggggcgatggcacttggccaaaccaaaccattttcgtcagcttgttgttctgtgattgctgataatagacgactaacaccaatcccgtatgaacccatgatgattggtttagcacgcccgttttcgtctaagaatgttgcaccgaattgttcagtgtaacgtgttcctaatttgaagatatgaccaatttcgatccctttagtgaattgtaatttaccttcaccgtctggggctgtttcgccttcttgaacaaaacgtaagtcagcatagtctgcgacgttgaaatcgcgcttgctgttgacgttgaggaagtgatgatcagcttcgttagcacctactacggcgttaacaagtgcttcaacactgtaatcagcaacgatttgaacatcttctggtgcattaacaggtccgattgaacccattggggcgttcatcgttgcttgaacttgttcagcagttgctaggtctaagaagtcagcatctaagaagttcttcaacttaacatcgttgacttcatagtcaccacgtacaagcactaagactggtttttcatcagcaatgaaaagcacactcttaataatcttttgagcgggtacttctaagcgtgctgctacttcttcgatagaatgtgcatcgccagttgcgacttttcccatttctaattgaacatcggttgaactttgaccaggacgaacccccgttgccatttctaagttagcagcgtagtcactttgatcagagtaaacaatcgtatcttccccgatttcagcaatcgcagaaaattccattgaatccttaccacccatggcgccggcatcaccaacgattgcgcggaaatctaaaccgcaacgttcaaaaatgttcgtgtaagcttggcgcatttgttggaaagttgtatccaaatctgcttcattagcagaaaatgaataagcatcttgcatgatgaattcacggccacggagtaaaccataacgaggacgatcttcgtcacggtacttcgtttggatttgatataacgttaatggtaacttcttgtatgatttaatgttattgcgcactaaatcggcaaatgtttcttcatgtgttggtccgaggataaagtctcgtgaatgacgatctttgaatttgaataagttagggccataagttgcataacgacctgattcttcccataattcagctggtaaaataccaggcatttgcatttgtactgcgtcgatcttgctcatttcatccttgataatcgcttggatgttttccaatacgcgataagctaaaggtaagtagctataaacaccagctgagacttggtgaatgtaacccgcacgaagcatcattcggtgacttttagcttcagccgaattaggcacttccttgagggttgggataaataattttgattgtttcatctaaaagaaaaatcgttgtatatcattccacgtgactaagaccattaataacaccataataccgacaccgattaatgtcacgatgccttctttttcaggtgaaattggtttgcgacgaatcgcttcaataatgttcaagactaacttaccaccatctaacgccggaatcggaattagattcataatccccaaattaagtgataagaacgccaagaaataaactaacgcattaaagccttgttgggtaaattgggtcgtcattgaatacataccgaccggccccgataatttatctagtgagaacccaccggttaaaaatgacccgaggatcttgaaaatctgactggcaattgaccaagcttgtgtaaagccgtaagaaatcttggcctttaggctatgatccattttgactttttgtgtgacccctacttgaccaaccttttctttttggttagccactttgacagccttgggagtcaccttgattgtcttttcagttgcgccccgttgaacgcgcaccgcaacagtttcgttagggtgttctgaaattatcgcactaaagtcagtgaagctcgctacttttttgttatcaaccttcaaaagacgatcgttggcttttaagcctgccctttgagcagccgaattcttttgtaccgtgccaatttgattggattgctgtggcacacccccgcttagaaaagcgaagaggataaaggctagaattgcgaggatgaagttattaaatggtccggcaaagttcgttaacatccgattaatcaacgttgctgattggaattggacatccacgggtgcgatttgcacttccgttccgtccgcttcgataatcgtcgcatcatgtaagacgggataacgtttcatttctgactcgtcgccgccttcataaccttcgacccacaattctttttgtaaatctgttttagcaatttggaaaggtaccccgtttaacgtggtgaccttgtcacttgtattaatctgttgaacgcgtccttgttcgtctaaaattaaagtcgcttgtgtgccagcttcaatttcagattcatcgtcggccattcccgccattcgaacgtaaccacctaatggtaaccatcggatggtgtaagttgtgccgtttttgcgagttgcaaataatttaggtcccatgccgacagaaaactcacgcaccaaaatgcctgagcgcttagccatgtaaaaatgcccaaattcatgaacgactactaaaataccaaagatgatgataaacgcaataattgcagccaactaaatgatgccaaacaaatgtagtaacggtagtacaaacaacatactatcaaagcgatctaagataccaccgtgacctggtaagattttacctgaatctttaacgccataatagcgtttgtaagctgattcaaccaagtcccctaattgaccacagattgagaagattaaggttaagcctaacatgattggcaatgagtaaatttgtgggaagaagtataagtaaactgctgcaacggcaacggctaataaagtcccgccaattgagccttcccatgttttattagggctaattgctggccacaatttattcttaccaaatgcacgaccaaacatataagccccaatatctgtcatccagataaccaataagatgtacatcactgtatcgaaaccgcccaaattacgagcaccggctaagtagtggaagccaagtccaatatacaggctggctaaagttgtgacacccatatcatcgaagtttacacggttcttcgtgaagaccgtgatggctaataagattgcgacgaatagatagaataaatcaaattgtgaaacaccatctggcaaccagtcaaacgctcccgctggtaatgccaaacttaatacggctaaaccggccaccatggcatctggtgaaacgataatccgtttgcgcataataaagacttctgataatgcgactaatgctaatacggctgcggcgatatcaatgaaaatgcccccactaattaaaattgggataaagataatcaacgcaacgaccgctgtaatcactcgttgtttcatctattttaagccgccaaagcgccggtgacgttgttgataagtaaaaattgatttttcaaaaacttgcggtgtaaaatctggccagaattcatcaacgaagactaattcactataagcgatttgccaaagtaaaaagttcgagatgcgttcttccccactggtccggatcaataattcaggatccgcatactcccctaagaagccagtcatcaaatattgactaatcaagtcatcatcaatcgaatcagcctcaattgtaccacttacggcatctttggcaatctgttggacagcctgttgaatttcatcgcgaccaccgtagttcaatgcgaagtttaaaatcatccctgtattttgcgccgtatcagccatcgcatcttgcgctgctttttgcgttttttcaggtaagtcatggatgttacccatgactttcacacgcacgttttcttcaattaattctggcatgaacgtgccgaagaaatcgacgggcaattgcatcaaaaaattaacttcatcactaggacgcttccaattttctgttgaaaaagcgtataacgtgagaaccttaacacccatccgactagcggctttagtaattgtcttcacattttccatccctgctttatggccagcaactctcggcattaaccgtttgttagcccagcgaccgttaccatccataataatggcaatatggttggggatattttccggatcaagttgaatttttgctgtttcttttttatttgtaaacaaatgaaaaagacattcgaactcttccgcttggattggcggcggattctcaaaagcccaatcgcattcttactaattctcgccctaattatcatcccatccctctacgcatggtttaatatctgggctttgtgggatccttacagtaagacacaagatttaaaagtcgctgtttattcagcagatcaaagcgtgactgtcgctaaaaagaaagtcgcaattggtgatgaattaatcgaccaattgaaaaagaacgataaacttggttggcagtttacaagcagtaaaaagcaattggacgaaggcgttaaaactggtaaatattatgccggtatttacgttcccaagaacttttctaaggacttaattagctttgtcgacggtaaaattcaaaaaccaacgattatttattcatccaatgacaagattaacgccattgcccctaaaattactagtgcgggcgcgacaacgcttcaatcaaccatttcagaggaatttgtccagacggttgctaaaaccctcatgtcctctctcaataaggctggctttaaactcgatgaaaatctgcccgtcattaaccgtttctcaagtatgattctcaaaacagaccaacagattccggagattaaccaatatacggatcaggtcgtcgcactgcaaaagaaaattcctgagatgcaggctaaattaacacaagccaatgacttcgtaaacttcttacccgaagcgaataaaatggctaagaaagtcgtcggcgtcaatcagtacctcccagaagttgaatccgcgggtgccttagctgttaaggtccaagggaagattccagaaattcaaagtgccggtaaacaggtggcaacccttgatagtgattttgacgggattgccaataccttaaccaatggtatttccgaagccaaaactggtttgaccgttcttaataagactcaaaccgtcctcccagaaatcattacctttggtaaatccgcgcagcaagtttctagtcaggttaaaaatgacctgattccaaaactcaaaacgaccttacctgtcattcaaagttctgttgatcaaggcttaacgattactgatcaattagcgaaaaatatcgataatgacttaaatgccgttaataaactattagaacaagctaaaaacgatcctgataatcaagaattgaaggctgccttgaagaccaacctcgagcaattatcagcccataccgcaacgttacaagctaacaacacgcaattggcgaataccttgcaaagtttacaagatgcttataatgaatcagcagtcgcagccggcaagcctgaatcacatctcttagatgatccaattcaaaagctcaacgccgctgcaacccatcttggtcaattaaaaactaagattgataacgtgctcgcccattatgatgatctctctttaacggatattcaaaatcaactaacaccaatcatcgcttttgctaaacaagttcaaaataccgtgagccaagttcaaaatgccggtatcggtgcgaacgttaagagcgtccttgctaaattcgaaacgatgattacgcaaggcgatgctgttttaaatcaaatcaacaccgctgtgctaccaaaattaccatcactattaacaaatacgcaaaaaacattaaaaacagctatcgattacctcgaaaaatatcaaaagcaaattccagcgctaaaacaagagatccacgatgccaataccctcttaaatggcaatatgggaaccatcgtcagcggtttgaacactgcttctgatctctatcaaaacgattacccaacgttgaaaaataaattgcaactcgcaaccggcttcatcaataacgatttacccggtatcgaaaatgatttaacaaccacgctagcaatggccaacgctaaatttccactccttgaaaaagcattaaatgatgccactgatttaattcataatgactggccattcttgagaagtgggattcaaaaaggcgcagaagcaattcgcaagcaacaaaagacagttgatttgaaagacttgatcaaactacttcgccgtgacgctactaaggaaagtaatttcttagccgaaccggttaagttacaagagaaacatatctatccaattaaaacttacggctcagcgagtgcaccgttctataccgccctttgtctttgggttggtgccctcttgctcagtaacatcgtcctcacgaacttctcgttagacgataaggaaaaagaacgttacagcaagaaacaacaatttatcgcccgttggttgacctacattgtcatcggggtcgcccaagcggtctttgtcgcacttgggaatatcttcctgattaaggcttatatcgttagtccagtagcactcttactactagccgtcttcctcagcaccgtctttatgacgattgtttacgtcttagccgcgatgttcggtaatgtcggtaaaggattggcgatgattatcctcgtgctctccatctctggtgggggcgggaacttcccggttgtcttatccgataagttcttccaattcattaacccgttattaccatttacttacggcgttaacttattgcgggaaccaaccgggggcatctacgcaccaaatctctggcataatttcattattctagcgatttacgcagttgtcttcttcttcatcggcctcttcttaaaagatcggattaatcctttcttcgaaaaactccataaagaagcagccaaaagtaaaattattcattaattaaccttcagtaatttctttttctttttctttagaaatagcatcgattttctttgttgcttcgttcgttaagttttggacttgttcttccaaatcgtgcatttcgtcttcactaatttcgctagccttttcagcttttttcaagttatccattgcgtcacgacgagcgttacggacaacaactttagctaattcagcttccttaccaacttctttagcgatttccttacgacgttcacccgttaattgagggattactaaacggattactgagccatcattagctggtgagataccgatatcagctgtgtaaagagctttttcgatatcttcaagtgcacctttatcataaggtgtaatcaacaatacccgtgcttcagggattgtgattgcagcaatttgattaagaggtgtcattgcgccataatattcgacgttgacacggttaactaagcttgcattagcgcggccggcccggatttgaccaagtgtccggcgcaatgaagcttctgctttttccatgttttctttagcttgttctaaaattggatttgccatttattcctctccttcaatcgttgtaccaatattggcaccttcaacaacctttttaatgttgtctgcttcgttcaagttgaagactaccaatggaatatcattatccattgataaagtacttgcagttgaatccatcacttgtagacctttgttgataatatctaagtgtgttaaagtatcgaacttaacagcactagggtctgtgttaggatctgcagagtaaacaccatcaacgttgtttttagccatcaagataacgtcagcatcgatttcagcagcacgtaatgcagctgttgtatctgttgagaagtaagggttccctgtcccaccagcaaaaataaccacacggcctttttctaaatgacggacagccttccgacggatgtaaggttcagcgatttgacgcatttcaattgatgtttgaacacgcgttgggacaccaatactttccaaattgtcttgtaatgccaaagcattcatgacagtagccatcatacccatgtaatcagcttgtgcacgttccatgcccatttgttcgccagtcacgccgcgccagatgttaccaccaccacagacgattgcgatttgaacacctaaatcatgaactgatttaatttcattggcgactaccttaacgatttcaggattgatcccgaagccttgttcgccggctaatgcctcgccacttacttttaagacaattcgcttatattttgtatttgtcatttatttgatttgacccataacttcatcaacgaagttattttcttttttctcgataccttcaccaacagtgaaacgaacgaagcctttaacactaccattttttgatgcaacgaattgtgcaacagtttggtctgagtctttgatgaatgcttggtcgtttaagctgatttctgacaagaacttgttaacacggccttcaacgatcttaggaatgatgttttctggcttgccttcgttctttgtttcttcagttaatacttcacgttcgtgatccaatgtttctgcaggaacatcttcgcgagaaacgtattgagggttaacagctgaaacgtgcatagcaacgtcatgagctgcttcatcgtcagcaccttctaaagtaactaatgaagcgatttggccaccattgtgtaagtatgaaccgaagtgatcgccatcatttttttcaactaattcgaaacgacggaagctgatcttttcgccgataacagctgttaagttgattactgcgctagcaattgtgccttcacccattggtaattcttcagcagcagccatgtcagctggtttgtttttagcaattgtttcagcaatatctttcaataaagctttgaattgatcgtttgaagcaacgaagtcagtttctgagttcacttcaacgattgcagcagtattgccatcaatagcaacgccagctaaaccttcagcagcgatccgatcgtttttcttagcagcctttgccatccctttttcacgtaaagcatcgattgcttcttcaacgttaccatcactagcaactagggcttttttagcgtccatgataccaacgccagttttcttacgtaattccattacttgagcagctttaatttcagccatctatttagcgtcagtgttagtatcgttgttgccttcaactgcttcaacgatttcttccattgagtctgctgatttgttttctgcagcaaatgtagcttcttcaacatcatcttcaccttgacggccttcgatgatagcatcagccattttagctgtgattaaacgaacagcgcggatagcgtcatcgtttgatgggataataacatcaatatcatctggatctgagttagtatcaaccatagcaacgactgggatatttaatttttgtgcttccttgatagcaatccgttctttacgaggatcaacgacaaacattacatctgggatgcgtggcatgtcttcgataccgcctaagaatttttcaagtttttcttgttgtttcttcaacaaggcaacttctttcttaggtaaacgttcgaaagtaccatcttcgtccattgctttgatttccttaagacgtttgatacgtttttggattgtatcccagttagttaatgtaccacctaaccaacggtgatttacaaagtattggcctgcacgtactgattcttcagcaattgcatcttgtgcttgtttcttagtaccaacgaataagaatacaccttcgttagcagcttcttctttaacgaagtcataagcatcgtcaaccatgcgaactgtcttttgcaagtcgatgatgtagataccatttctttcagtaaagataaatttcttcatttttgggttccaacgacgtgtttggtgaccgaagtgaacacccgcttctaataattgtttcattgacaatacagccatttaaaattgggtactttcaatcccgtgtgcgattaagtactgttccttttttaaacggctttggtgtttaaaggcgtattcggcttttaaagcggatgacttgtccgcaaatgtttcgtaatacaacaaacgcactgggcgccgaagcttcgtgtacttcgcacctttaccagcattatgtgtggcaacgcgtttcgtgacgtccgtcgtaaagccaccataaaaactacgatcggcacagactagtacgtaaaaataataagctttctcagtcattcagtcatcttctgccatgaataacttcgtgcgcatttctggtgtataatcgctgttttcatcatagatcgtaagttccggaagcattcgcaagcctccttttctaccatctttgacggcttcaatcaataccatgctggcttctttacctgcctttgggtaaacaaaccggacacgcttgggttccatgcgtgctgcccgtaattcatcacagatttctaggaagcgttctggacggtgcacgagatatcctttaccattcatcttcaacaaaccactcattgtttggaccacggttcttaaatccgtcgcaatttcgtggcgtgctaaggctagatgttcattaggattcttttgactattaggcgccaccttaaagtacggcggattacaggtcacaatatcgacgctatcttttttaataacggtcgttacgtcttttaaatccatatttaaaacacgcagctgttccgtcaacgcgtttagttcgattgaacgttgtgccatatctgccaagcgtggttgtaattcaacccctacaatttgaccgtttgttttggggctcataaataggcccaccgccccattaccagcgcataaatcaacaatcaggcctcgcttgggcaattgcgcaaaatcagctaataagactgcatccattgaataagaaaagacggatgggctttgaataatttgaatatctaatcggaataactgatcaattctttcatctgcttttaacatatgtttttctcatttgcccgcttcatcgtgcgaattcttgcctggttacttaatggccgaatcaacgttgaaaacaaatcagctttaccagagggcacctacgttttagttggcccccatcggacttggtgggatcccatcttcttcgcacttgctgcaagccctcgtaagtttacgtttatggctaaagaagaattattcaaaaatccaatcttacgttttatcttgaaacacgccaacgcgtttcctgttaatcgtcaaaatcccggcccctcagcgattaaaacaccggttaaagccctacgttcaaaggacttatctttaatcatgtttcccactggtagccgctattcaagcgaattaaaaggtggcgcagtggtcattgctaaaatggcgcgggtcccattagtccccgccgtttatcaaggccccttgaaattttcagacgtcttaaaacgtaaaaagattacgattcgtttcggcgaaccaattccagtcgaccctaaacttaaattaaacgacgaaaacctgacaatgattggtgatcaaatgcaagccgcttttgatcaaatcgatcacgacatcaatcctgattttaaatatgagattgacgatcacaaataactatttttcccaatactgatccaagaattttgcgaccttattgcgataagctgttggttgcttggctaatgcttcaccatggcctgcatctggcacaacccataattgcttaggcgcattagcggctttgtaattttcgtaaaccatcttggttggtacaaatttatctttagcgccatgaatcaacatgattggtaattttgacttagcgagactcttggttgcgtctccttcgctaaagttatacccagcacggacccgcgccatcaagttagtggtataaaatagtgggaacttcggcaaaccaaacaaatcgttgagttgataggccaactcacctgagatactgctgtacccacagtcttcaatcactgctttaacctgtttaggaagcttttcgccagcagtgtacatcacagtggcgccgcccatgctaaccccgaagagtgcaatttggctatcttgaccatttttggcaatcacttgtttgatccatttaacgtaatctaagcgatctggccaaccatagccaatataatccccttccgattcgccggaaccacggtcatcaggtgccaatacgttgtaccccaagtcatgatagagatgaatatagcgcgccatatcctctttgtagcccatatagccgtgtgccacaacgattgttttagttgttttcttagcagctggtacgtaaatcgcgtctagcttaagatcatcagtcgctgacttttgataccacttcactttatcggcttttgccaaccatttctgattgtcgcgataaaacttgctaggcttgccattattcaagaatgacttttgccctggtacgaaagcatattgatacatatacagcgttgcgccaaagacaccaatcacaattaaaataacaacgcttattaaagaccatttaagccagcgtttctttttcatttatagcccactctgtccattttgtaattgatacatttcataatagcggcccttttgtgcaaccaagctatcgtgattgccccgttcgacaatttgaccttgatccaagacgagaattaattctgcgtcacgaattgttgataaccgatgggcaatcgcaatactagtccgtccctgtcgcaagcgagcgagaccggtttgaattactgattccgtttcggtatcaatgttggcagtcgcttcatctaagaccagaatcttcggattggtcactaatgttctggcaaatgagagtaattgtcgttggccactcgaaaattgtgcgccaccttcaatcactcgtgcatggtattggcctggtaattccttaataaattcatccgcttgaacaaattcagcagcggcttgaatctgttcatccgtaatttcatcgttaaacaagcgaatattagaagcaatatccccgtaaaacatgaacgcatcttgtaaaaccaagcccattttacgccgtagttctgctgtttgaaagctgcggatatcttgaccgtcaattaaaatttcgccttcataaaattcataaaagcgcatcatgacgttgataatcgaacttttaccagaaccggtatggcccactagtgcaaccgtttggcccggttcaacgacaaacgaaatatcatggagaatttcatgcttgccatcatatgaaaacgacacgtgtttgaactcaacgcggccatcggtaatttgactagcagcatctgcatcttgggctggtgcaaattccgtttgatccagaattctaaaaatacgacgcccggcaaccatcccatcttgtaatgaggataatgaatccatcatattggtcatcggattgaaaaagttgctaacgtacgtcgtaaaggcataaaccaatccagccgcaacaaaactatgcaacgctgtaagcccgaataaagttaaaacaaccactaatgccagtgtatacagcaagttaacgaccggtgctaacaataaagaattagtccgaatcattgcttctcttgttttaagataatcttcgttaaccgattcaaattcggctgtgagtcgtttttcttggcggaactgttgaataattgtaatcccttcaatcgattcgttcaacttagtgttcaattgactcaacttttcacgcatatgccgataaaccttggcactataactgctgtaataccaaataatgactaataaaattggtaaaaaaccagccgttgctagtgcaatcttcggtgataataaccacatcgcaatgaacgcggagataattgaaaatgaacccactaataatgataggaacacattccaataatcaattaacgtcatcgtatcattggtaactcgcgaaacaattgatccagcaggtgtttgatcaaaataacgcatgcccaaacgatgcaactgacgaaaaagatcacggcgcacatcttccatcgcgcgttctgatcccattccaaagaggaaagattgggcaaactgcgtgatagctttcaaaataacccctaaggcatataacccagcaacccctagcaaaatttgagttgtcgctgtttgtttcgttaagtaacgatccataaaaacttgtaataagcgcggcaacaaaatgttaatcgttgctaagcccgctgctgcgatgattgcgccgataaattgtttcttatagcgcttggtataaccaaaaagtcgtttcataatttgaaactgttctttagtcgatatcttttgtgaccattcagattgatacttttgtgccatctattggccccccatcgcttgatttaattgttgtttaacccacatttcagcataccacccttgttgggctaataagctgtcgtgcgtgccacgttcggcaatcgttccgtcatccataacaataatctcatcagcgtgcattacactactgagtcgattagcggtaataattgtcgtttgatttgcccgtagcgtcttaagattcattaaaattgcttcttcagtcttcgcatcgaccgcggacaatgaatcatctaaaattaaaatttcaggatcagtcattattgcccgggaaatagcaattcgctgtttctgtccacctgataatgacacgccacgttcaccaacaactgtgtcgtaaccttgtgcaaacgttaaaatatcttcatgaaccgcaccagaactagccgctgcttcaacggcctcttgttccttttcaaaatccgcgaaccgaatattatcgcgaacatccgttgaaaacaaaaagttgtcctgtggcacatagccaatactatcgagtaatgcatctaatgtgtaatcccgaatatcgtgctggttaatcttaatttggccctgatattgatcatattctcgtaacagcaacttgatcaaagtacttttaccagaaccaaccttcccgacaattcccagtgtctttccttgtggcagttggaaatgcacattcgttaaagttggtgtttgttcttcaggataggaaaattgttgaatggcatagtcgatatcaccagttgccaacgtttgaatggcatctggcttttcaataatcgtgctggtttcttttaataatgattcaacccgatcataactggcattgccacgttcaagcacattgaataaacgaccaatcgcaaacattggccaaactaaggctgcgatataactgataaaagcaatcaattggccaattgtaatactgtggttcatgaccaacgttccaccataaataattgtaacgaggtacgttagcccgataattaaactaatcgctggatcaaataaaccatcgataaagttgacgcgcttgttaatcgcaattgtcttcgtcacaatttggtcgaaatcatcgatatccgcttcttcttgaccaaacgtttttaaaactttgatcccagaaacactctcttgcgtcttatcatttaatttcgaaaaggctgcttgtgattctctaaaagcggtatgcaaatgcgcccctaagcgtcctgaagccactgctaataatggcatcggaatcaaggccattaatgtgagccgccaatcgacaaaaataatcatcgcgacgatcgttgtcccacctgtaataatcgaatccgcaaacgttaaaataccggcgcctgccacttgttgaatcgcggttaaatcattggtagcatgggccatcaaatcgccagtgcggtgcttctggaagaaagttgtgtccatcttcataaaatgccagaacaaacgactccgcaatgtccgttctaacttggctgcgccaccccagatacgagtccgccaaccatagcgaaagagatattgtaaaatcgtggctgctaataagaccccaatccacattaataagaccgatgccttcaactttcgggcagccattaaatcaattaacgtcccaatcacttttggtggcacgatttgcacaattgcaactaggactaaaaaaaaaacccctaatatatagcggcgatattcttgtttaaaataccagcctaatttcttaaatatacccatttattttttgctacgtttttgttgtactttcattgagctcatcatctggtttaatttcttttcagatggtttttgccccatttgcatcatcatagctttcaacatatcttcattaactggtggattttcttcgaaatatttcttcatgtaagcacgtgcgccgaaaaagccagcaactgcacctaataatgccccaatgacaaaaattaatacgcctattccaatattcatttaatcgtcacgtaaacccttttcacgttggatgtccttcactttttcaggtgtgacttccttaccttctttatcataaacttgtagcatctcaacttgtgaacggaaactagaacggaaatccttcaaataagcgtcccgtagttcttgacgttccgttgtttcttcgggtgttaacccttctgcctttgctttatttgctaattcgttgatacgatcgagtcgtttttgatccattgccatatgactaaaactgaatccaaacaattagaggtcttacgttttattcacgaacgtgttcaagacaaaggttacccaccaacggtccgcgagatttgcgaagccgttaatttatcgtccacttctactgtccatggccatttagcccgacttgagaagaagggcttattacaaaaggatcccactaaaccacgggcgatcgagttaacgcccgctggcctaacggcaattggggcaacaccccagaaaatcccagtattaggggtggttactgccggtgtgcctatcttagcagttgaagaagcaactgattacttcccgcttccacctagtttgcaaaccgaacaagatttgttcatgctaacaattcgtggtgaaagtatgattaacgccggtatcttagatggcgacgaagttatcattcgcaagcaatcaaccgccgataatggcgatattgtcattgcgatgactgccgaagatgaagcaacctgcaaacggttcttcaaagaagcagatcactatcgtctccaaccagaaaacgatacgtttgaaccaatcattttaaatgaagtcagcattctagggaaggtcgttggcctttaccgggatcgcatgtaattagtattccattaatttgaaaatatcatagtccttaatcttttcacggccgtttaagtccttcaattcgatgaagaaagctgtcccaacgacgatgccgcctagttcttcaaccattttgattgttgcggcaattgtgccaccggttgctaataagtcatctgttactaagactttttggcctggtttaaccgcgtctttatgcatatataatgttgatttaccatattctaaaccatagctagctgaaactgtttcgcgtggcaacttgcccttcttacgagcaggtgcaaacccgacacctaatttgtaagcaaccgggcagccaacgataaagccccgggcttcagggccaacgatcatttcaacacctttattcttggcgtattcaacaattttatccgttgctgctgcgtatgcttcaccatcggacatcaaaggtgagatatcacgaaaagtaacgccagcttccggaaaatccggaacacttgcgacataatctttaaagttgattgacatttagcgatttgctactgctgggagagttgctagccagtctttcacctcggtaaaggttgaataaacaagctgtttttccatttcaattttagctaatcgtttttgataacttggtgcactttccagtgcatgcttttcaggttgtaactcggccgtaatcagaccacgttctattctaacaaatccgaggtcaaaaaacacctgcaacatgaaaatcattaacggtaattgtaattttaaatacgccgctaattctgctaaccgcgctttttcaatatttggatgtttccgcaagtaaactaagaaagtcgcaaactgttgttttgtcggcattccttctaagtaagcagagtgtttagcataaaaaatcaagcttaatttagcggcctgttgttgttgataaaattgttcaaaagcagttaaatcagctggttcatcaactacaattagctcttggctagtagcaacttgttcatcggtcgctaacagcgcctgactccctgccggtaaataagactgcagttgctcgcgcattttatcattaaaaaagacgtagtcgcctgttgattggaataattgttttgtcagacgattgctacgttgatcaagtacgacttgcccacttgtagcaaggtcttttaccattaattgcaacgtcgtctggccacgccaagtattctcactcaaactcccgactaatttcacatcttcagcggcagttaaatcgggcatcaaagcccctttattgaaagctaaaaccgctaattgttgttgttgatcgaccgccatcatcttcaaatgcttctgatcagcaccgatttgtttgacatcggctaactggggcgcgctaagttcaatcaacggttctggattatcactgccaaaaggtgccagttgttgcaatgcttgatataaatcaggcgtaatatcagctagcgtcagcgccaaatcaactggtaatggttggcgtcctgttaaatctaactgattaacttgcgcatactcgttcattgcagtttgaatcagcgctaattgatcaaccttagcagtcaagccaactgccatgtgatggccaccaaaatgaaccaataattcacggtgggcatctaacgctttaaataaatggaaagctgtcacactacgaccagagcctttagctaagccagtttccgggtcaatcgtcaagactaaggttggtttaccggtctgttcaacaacgtgactagctacaatccctagcaccccttcgtgccaaccttcatgggcaataactaaggttgcactcgcttgattttccgttgtttcagcaattgtcattgccattgccgtaatttcctttaccagaccttggcgttttttattttgttgttcaataaattgtgcctgttcgactgcttcttcgtcatcaagcgtcgtcaacaattgcacaccaagggtcgcatcacctaaacgaccaattgcgtttaaacggggaccaatcccaaagccaatgttagtggcatctagtgtcgcttgttctaagccggctgattggcacaatgcaaccaaacctggtcgatcggtattttgtaattgttgtaagcctaagctaaccaacgtccggttttcatcgactaaggggacgatatcacaaaccgtcccgattgcggctaaatctaatttatcgtaaggaatctcttctaataaagcagtcgctactttaaacgccacaccgaccccacagagttcgccaaaaggatattgcccttctggatgtctgggatgcacaatcgccactgcgttgggtaattctgatggtaattcatggtgatcggtcacgaccacgtcaacaccgtgttcttgcgcataagcgattggttctaagccactcaccccgttatcgacggtcacaattaattgggtgccattttcaatcaagcgtttataagcttctaaattaggcccgtagccatccttaaaacgattaggcacatagacttcaacatcggcacctaagtcgtctaaagtttccttcatcaaagtggtacttgtgatcccgtccgcgtcataatcgccataaatcgtaattttttcgccgttcacaatcgcttcttgaattcgatcaatcgccttttgcatatcatgcaaagcgtatggatcgtgaagttgaccgacattgggattcataaaatcattgatctgctctgcatcccgcaagccacgttgccacaaaagttgggccgcagccttgggtagcggattgtcttttgtaattgtttgtaattcatcttcagttggtactggttttaattgccattcatattgtgcttccaaatgtcaattctagttttagggggcgccggctacatcggttcccacaccgttgatcaattaatccaacgcggctatgacgtcgctgttgtcgatagcttggtaacgggtcatcaaggcgccatcaatcaaaaagcccgtttttatcaaggtgatatccgcgataaagacttcatgcggaacgttttccaacaagaagacgtgactggtgtcattcattttgccgccttttcaatcgtgcctgaatcaatgcaagcaccacttaaatacttcgataacaatacttatgggatgaccgccttattagaagtcatgaatgaattcgatgttaaacgcatcgtcttttcttcaactgccgctacttatggcgaacctaaatcaattcctatcaaggaatctgatccacaattaccaaccaacccttacggcgaaagtaaattaatgatggaaaccatgatgaaatgggctgacaaagcttacggcatcaagtttgttgcattacgttacttcaacgtagttggcgctaagccagacggttcaatcggtgaagatcaccatcctgaaacccatctcttaccaatcgtcttacaagttgcggctggcaaacgtgatcaattatcaatcttcggtgatgattacgatacaccagatgggacgaacgtccgcgattacgtacacgttttagatttagcagacgcccacatcttggcctttgaatatcttgctgatggtcatgacagcaacgcctttaacttgggttcatcaactggtttttcaaacatggaaatcgttgaagctgctcgtaaagtaactggcaaagcgattccacttgaaatggcccctcgtcgtgccggcgatccaagtaccttgattgctgctagtgacaaagctcgcgaaacactcggctgggcacccaaatatgataatatggaagcaattattgaaaccgcatggaattggcatttaaaccatcctaacggttacgctgatcgctaaatgtctttattcatcacaattttaacgagtttaatcgccatcgaacatctcggcattatgggactcgaaatgttcgctaacgatcaaacaaaagccaaggccttcgatatgccacttgattttgttcggctgcccaacaccaaagtcgcccttgctaatcagggaatttacaatgggatgcttggtgtcttaatcatcgccgtcaattgcttattgaccggtgccgcattaaaaaccgtcttagcattgttaatgttatacatcttcatcgttgccctttatggcacttttaccgcaacgaaaaagattttcttcttacaaggcttaccagcgctgatcacattgttactaattttaatcttttaaatgactaatcaaattttaattaccacgaccgaaagtattcctggcaagcactacgaagtgctcggtgaagttttcggtctcacaacccaatctaagaatgttttcaaaaatatcggtgcctcacttaaaaacgtggttggtggcgaaattagagcctataccgaaatgatgaccgaatcgcgcgatgtcgcaatcgaccgtttacgccaaaacgctattgagatgggggctgatgctgttgtgatgatgcgctttgactctggttcaattggaacggacatgcaatcagtcgctgcctacgggacagccgttaaatatatcgactaattatgctgctggtacttcaggctgcgtattatttaatgtccaagtgatatcactagagaaattttcaccagattcaatttgaagatctggattggcagccatcaataagttacccgttacttgccaagcgtttgataacttggtcgatgcaatcgttgtttcactattattatcaaccaatcctaaattagctcctcctggtaggccactcatattaaccgtcgttgtattcaatcgatgaccagctttagatgccattttagtcatctttgccgttagtttccaacccggattaactctagtatcggtaatttttaacgtgtcactaacttcatatggctgattctgagtgtttgttcccttataaacatctttcgctaaaacattgccaaatctaaagttaggcacttgatccaatgttaacttacctaatgagggctcaacttgtagttcggccttattagagacaacgacgaccttttctgctttcttacttgattcttcttcagaatcaacactcgtcgttagtgttagctgcgcttgataccgcttaccgctagcagtcgcagctgcggcctgtttcataaactggctatctttagcaaacgttaacggttgtgccgtatttaaattagccagattattaatatcaccgctactatttgtcacgccactatttgctgacaactcaatcgttttaccagtactatccataaaacgccatgcataatgccaagcactcgttgcgccggttgcaatcttaaagttagcgggaattcccggtacattaggatcacgattgacttgattgacgtaataagaatctggtacatattgtttgtcgctacccacttcaccattaccggccattaaagatgtttttcgaccattacttggtgtaaatttcaagagatctttagcgctggctgcttgccaagtaatatcatcggtcgaatcgactggatcaataatcgctctagcaccataatcaacatccgaatagatgactttaggtgtaccgtcagcattatccgtatcggcattaatcgatttagccggtttcggttctggcgtaatccccactttcgctaaatcagaatagaaagtcttattaaggggccagataccatctgaaaaactaaattgataatagtatgtcccgacacctaaattgcccgacttatttaaagcatagtcattaatatctaaaaagcccaaagagcccatgatcaaagacaaaccggtctttgctttaggttgctttttatcttcaacccagttgttctgactagcatcccagtgccaacgccgaacagtaatgtcttttcctaacccattacctaagttcgttaggatactcatccctgagaatttagccttatcaatatcttgtagcgcaaaataatcttcttcttgcggctgacggctaaaccctcttctaaaaattgttaataaaaagctccatccgtcttttgaaggtttatctgcattactaggtgtaccaactggttcagcactgcgactagttggtgcttgctcactcgtagctggcttttttgtattgacatcgattgattctgttgatgtttctttttcagtttcactcacactggttgctgactctgattcagccgcccaagcctgacccggcacattaatcaaactaccactgagcatcattgccgccaaactcacgtaaattaggcgcttaatttgcatttaatttgcatcgtagtccgcctccttcgtattagattgttggcgatgccagccaagtaccaatagaattatcgcactaccgattaaacttaatagtgtactttttatagcacccgtttgtggtaaacgaccagtggcattttgggaaccactcgctgtgtaatgaatttcttgaccattttccggtattgttggctgtgcaacaccaccatcctgaccatgattcccgggtggcgttggtcttttttgatcaatatgcaccgcaaaactagcggtactttgtccactatcaatccgattagctcgtactggttgcgctaccgttaccaataagagtatcagtaacaacaatcccatcattaagccttctttacgtcctgataaactactcgtcatctactcgtcatgttcccctacacccctttttcgaccaattaaataggcgactaatgctatcactaataataataaaatccctagagaaccccataaccaccaatttatccctggtttttctggatcaattagcgttttgttaacttgttcccgtgtcgcaccatcaaccgtaaaatgttgttttaaattaaaggttttcttacccgataccattttgacatgataggtatagtgacctttgggcaaaattttattattcgtctcaattgcatagttaaatgttgagcgcggtgccattgataatttttccgcgttcttccgatatatttttttagtttgattctttttggtaatccaagcatgcatcttaatttgaccaaacattgtcggttcatgattagcgatttgaccaacaacttgcggcaccccactggatgaatccatcttagtcttcgttaaggttaatcgaggtgtgattttctgatcaaaatcctgtgtcacaacgattggaacagtcatcgcaaaactatttttaatgccgaaccccttcttttgtggttcgttattcgacgttcgtttcacataaacactaccaagaatcgttcctttaaaaccattttggggtattttaacgttaaaagtgactttttttgaagcacctggcgctaatgttaaactttgtttgcgggcctcttttgagaccaaatcaggtaacaatggcgcttttgttttgaccattttttgatgcgtcggtgtatagtcaatactgccgctatttgacgttgaggcggctacaagctgtgcattgaaatcatttattttcttcgtatttaaattttgcacgttgacggtaattggatatgtttgccccttttcggctttaattgcgaaataacccaaactagcatccgtttgtcctaacccatattcaggtgttacggtaaattcagcaccttcagcatgcaccgcttgcgcaaaactaccaatccccaccaataaacatattaaacctaacattgtgattaatactttctttttaaacaattaagcttctggtgcaactggggctgttgatgataagttccagttaattgttgttgagaaagcttcatcttttgctaaatcagcagctgggttagctgccattgtcaatttactatcggcagctgccatgttgaatgtatcaacaccatgggcaccgttacctttgacaacttcaactgcacttgcatcatctttaatagcagttgctaaatcttcacctaatgaaccagtagaagctaagttcaacgttgaaccatttaattggttatctttatcggcaaattgacccatatcagctgttaatgtccagtctgatgcacctaaacgtgtatcagatacttctaaagtaccgtctgcttgtgcttttttaccattaaacccagcataaatatcactagcttcaattgtaccgaagttaaaacttggtactgattttaaaaccaaagtaccgttttcaggatctgttgggttagttggatctttagcaacaaccgtaaagtcttcttttgatgtttgtggtgttaccgcatcagctgatgctgaaccgattgtcattgcggctggtgccaccaatgctgctactgctactactgagaataatttagtcttcatttatttggcaatcaccaatcttcttgtatacaccgcttgacccgaatgcatcactgcgtcatcaataatcgaaactaaccgcgcaccgcgtgtcactgccggcgtccaattatcatcaatcacttcatctagactttccagagaaacatcttggagataagtttgtgttaacttaacagcttctgccaagtaatcgattagaagttggcgatcagagacgactaccttggcagcctcttcggggctatgctgccaatcttgcgtatcatctggtaacgctaacccaaaatggcctgtccaattagcactgagccacaatggtgtttgtccctttaaatctgaaatctgatagtctaattcccgtgccgtatgccaaatgagccatgttactgatttgataagtggattaggcatcgtattagcctcctccagtgtcatctgttctaaagcttctaacagacgttcttgggcgcgagccaccgtttcaatcgataattgcattgcttccatcatatgtcatcagcacaacaaattatcctattatttatcgtcttctgttcagcagttgccgttcttggctcatccctaatgagtttcatcgccttttataaacataacgcgaccctcagaaaaagcgccagcgtcactttctggatcagcatcattatcctcgttatctttctaaaactaatcgatatgtatcaataattatttacctttggtatcttcatcattcatcttaagaatcgacatgaaggcttcctgcggcacttccactgagcccacggatttcatccgtttcttcccagccttttgcttttctaacaatttccgtttccgggtgatgtcgccaccgtaacacttagcaagcacgtttttccggaaagctttaacagttgaacgggcaataatcttattcccaatagcggcttggattggcacttcgaattgttgacgcggaatcgtttctttcaacttaccaacaatcacacggctccgttcaaaggcaaagtcccgatgcacgatgaaactcaaggcatcaaccgcttcgccattcaagaggatatcaatcttaaccaggtcactggcccgatagcctgtcacttcgtaatcaaacgatgcgtaacccttcgtatttgatttcaaatcatcgaagaaatcaaaaatgatttcagaaagtggcatgttgtagatcacattaacacggtatgtgtctaaataatccattgttacgaattcgccccgtttacgttgcgctaattccatcacagccccaacataatcgttagggaccatgattgacgctttgacgtatggttctttaacttctgaaatattcgatgtttctggcatttctgatggattatcgatcacttcttcagtcccatcagtcaaggcaacatggtaatcaaccgatggtgctgtcatgatcaagtctaaattaaattcacgttccaatcgttcttgaacaacatccatgtgtaacagacctaagaaaccacaccggaacccaaagcctaaagcttgcgatgattctggttcgaactctaaagccgcatcgtttaattgtaatttttcaagcgcttcacgtaaatcattaaacttcgcattatcaacgggatacatccctgaataaaccattggttggatatgacgataaccatcaagtggtgcatcagctggattatcagctaaagtgaccgtatccccaacgcgtgtatcttgaattgttttgatgctagctgtgatataaccaacatcaccgaccattaagaaatcacgtttaaccgctttgggtgacatcacaccaacttctgtgacttcaaattctttaccgctgttcattaaacgaatcttgtcgccgactttaaccgttccatcgaccactcgaatatttaaaacaaccccgcggtaactatcataatttgaatcaaaaattaaggcttttaatggcgcttctaaatcaccagttggggctggtacatccgtcactagtttttcaagaatttcttcaatcccaatcccacttttggcactggcaagaacggcttctgacgcatctaacccaatcatttcttcaatttcagccttaacaacatcaggttgcgctgatgggaggtcaattttattaataaccggtacgatttcaagatcatcgtcgaccgctaaataaacgttggccaatgtttgggcttcaacgccttgcgctgcatcaacaactaataaggccccttcgcaggccgccaaacttcgtgacacttcatatgaaaaatcgacgtgccctggcgtatcgattaaatggaaaatataagtttcgccatctttagcatggtagtgcaattccaccgcgttcaacttgatggtaatcccgcgttcccgttctaattccatgtcatctaagacttgcgcttgcatatcgcgcttggcaatagtatccgtcatctcaagaattcgatcagctaatgttgatttaccatgatcaatatgcgcgatgatcgaaaagttacgaatgtgtttttgccggtctaacatttctgcgtaatccatctatttttctggattcgttttagctttttgtttatctttttttgcttcttcttgcgatttatcatgggtcacttcttcgacgaccttcttaactgtgccttcaatctgatctttaagactatctaaacgttcttcatttgccatatgacatttttaatgactttttcaaataacgagaccgttactttaccggaaacagcacgtttccacgcttggaaaaacgatacaagttatctaagcgttgatgaagaccaagccttctatttagaagcaattttctcaggaagctatcaagaagctttggaatctgctaaagccaatcaacaaactgatagccaacccgttaatgtcctcgccggattattagccagcgctgactggttaacgctcgacgaacatccagataaatactaccgtactagcacaattgtttcattagaagtgcaatcaaattaaatgacaattctattgacgattcttttaatcatcagtaccatcaccagcatttattatttcacgaaacacccttatcatcgtcgcttctggttgagcctgacgtttttgcttgtggcaatcatcggcttaggcaccaccaatacactgattaatgcggccagtgcctcaaaaacgaaggttcagcacgtttcaaaaaaagaaggccaacgtgccaaacaagaagcactcgccaactcaacctcacttaaaaaacaactagcagccaaaaaatctgaagctagcagcttatcaatcgcggtttcagaacaagaagcacatattagttcacaagaagcggctactgaaagtagtgtgcaatcgactgccacggttgatacaacccaaacaaccactaatcaagctgaagaaatggtgacagtggcacccaccgccggtaaaaaataccatcttgatgcgaactgtcgcggcctaaagcgtgccacgagtacaacaaccatgactctggccgaagcacaagcacaaggctatacactttgcggctgggaggattaaatgtcaaaattaaaagcaaccaccaccctcattatcggattacttcttgcaagtagccccctcatcacaccagaaccaacccaagccgcttcagggactgcggattatcaacaagcacaaaaaattaatcagaagaataaaaagaccggcaagaaaatcagtaaattacaacgtcagattaacaagctcaataagcaactcgctaaactggcaactgaaaccaatacccccatcgctaatacaacaaatcacgctgcttctgagctggcaacattagattatcaaggtgataacgaaattatcgtcaataataaccagcctacctttacgacggctgatcttgccactacaaatggaccctggcagacttttagtaacctcgaccaattaaatcgggccggcactgccaatgcgctcttaaataaaagtatgatgcccactgccaaacgggaaggtcttacttggaacccgactggctggcgtaataaacgggtgaaatccggttggctctataatcgtagtcatttaatcggttatcaactgactggtgaaaacaacaaccctaaaaacctcatcaccggtacccgccaattgaatgcccccgaaatgttggcgcacgagtcggatattgcagcctatcttaaaaagcatccctcaagtgacgtgcgttatcgcgtaacacccatttttagagggaatgaactactggctcgtggggttcaaatggaaggtcagtcaattggcgataatagcattcaatttaacacttatatcttcaacgttgcagatggtgttactttaaattacgcagacggttcaagtaaaactgccaaataaatgcaaaccaaatcacatcagatactgaataattttgatatcaagattctaggaatcttactcatgtttgttgaccatatccaccagatgttcgccggagcaggcgtccctgactgggtcgattggttcggtagaccagttgctactattttctttttcatggcggttgaaggtttcacgcacacacgtaaccaaaaacgctatctgactcagctgctcatcggcttttgggtgatgaattttggtgatcgactcgttcagcaattcttcacagttggtgatatcgctttatccaataacatcttcacagatttatttattgccgtcctagcaatgtatggaatccaagaaatcacagctggtcgtcgggcccataataccaagcaaatggtaattggttttttagccattatcgtgccaatcatgatgtcggtactcgttatcttgttactagttaatcccaaaacagcaatgttagcagcaaatatcggcatggttattccaaccatcacacttgccgaaaattctatttttctttatatcggtgtcttcttttaccttttccgcaataatcggttactgcaatgcctgacaattattgtttttgccgttattaacgcaggcgctaactcaggttttatctttactggtttattaacgactaatacccaatggatgatgatttttgcaatcattccaatcctgttatacaacggtcaaaaaggtcgaagtatgaaatcgtttttctacttcttctacccaatccatatttggttattatacattctcgcttcattcatcatttaaatggtaaaatcatatcaaagatattgggcacgtattcttgatttcacggggacctcaaatcgtcccgatttttggtggccaattattattaattacattttaggtggcattattattgggattattcaggcaatgaccgggcatccaatctcagaaatttataacattggtgatttaggcatttcgatgggccgtaatatcgtagttttcattgtatggatcgcaactttatccgttaaaatccgtcgtctgcacgatacagaccgctcaggttggtgggttctcattgaattcgtaccactgatcgggacaatctggttctacatcttaatgctcctaccaacaaaaacaaatcgttgggcataattacgccgatttaaccactaatcgtttctcagggaagcgttctttgaggaatttagctagtgtttggctatctaatttaaattttaacgtcgtaatttgaatttgaccgctaaagacttgaacaaccgtttcggcctcttttgtgattagttcaatcttcgaaattgcggcaaattgacgaaccgtatttaaattggcaattagcatggtcttggtaaacccttttggccaaaaggcgaagactaacaagataatgactgatgcaacacctgtcagtttatcatctaccgatcccgtgacaacaacactggcaatcagtaacccaattgcaattaccgttaaaatgatgcgcatcacgcgactactcttagcacgatataccatatgaaactgcacgactagccaaatgactaataaagccattgctaggatgctataaaaaattgtaaaactcgacatttatttaatttgaccgactgacataacgtctctggcaatcatgacttcttcgtttgtaggtactaggagcaccttaacttttgaatcatcagtactaataatccgttcttgtgccataacattgttccgttctggatcaacttcgacaccgaaatagctaaggcgatcgccaattcgttgacgcattaaaatatcgccttcacccatcccagctgtaatcactaagacatctaagccacccataatcgcaacgtatgaaccaacatacttgattaaacggttaacgaaaatatcgattgccaattgtgattctgggcgttcttctcttgtcttttcaagatcacgcatatcaggtgataatcctgaaataccgtaaattcctgatttcttgttcaagatgtcaatcatctcttctggatctttgatatctaatttcttcattaagaaagcgactaatgatgcatcgatatcaccagaacgggtactcatcgtaacaccagcaagtggtgtgaagcccattgaagtgtctaatgatttaccatctttgatagcagtcattgaaacgccactaccaagatgcatagtaatcatcttcaaatcttctaatggttttcctaacatttcagcagcacgatgtgaaacataacggtgactagtcccatgagcaccgtatttacgagccccatatttacgataataatctaatggtagactgtaaagatagttttcttcgggcattgtcgtgtggaaagaggtatcaaagactgccacttgtggcacattaggcaaaatattacggaaggcgcggatcacaccggcttcagcaggattatgcaatggtgcgtattcagctaattcttcgatgcgttttaatgatgcttcagtaatcaaggctgatgttttaaaatcttcgcccccggcaacaacccggtggccaatcccactaattttagaatattcagcaataatcttaaattcgattaacttcttaagtaataaatcaaccgcaacatcttgagtttcaatatcttgcgtgatttcatatttttgaccatcaccatatttaacagtgaagacagaatcggataagccgagacgatcaaccatccctttggcaatcaccttttcttcaggcattacaaataatttccattttaaagttgaactgccggcattaattgctaaaatttttgacatttaattaatattttctttatgccaagtccgaatctgttgtaaatacgcagcgaacgctttttgatcgtttgaatttggaaattcacctaatagaatttgcttagcttgttgggcaccagcaccttgtttttgtaagactaagatggctttttgaccctctttagtcttaaacaagttaactggtaagctcaataaaccttgcaagtagacgtgtttagtaatccattttaccagttgcttcgcttcatctgtttccaaaataacatttggtacaaggaagaaaccaaaaccgccgtctttaacatagtgcatcgtttgttcaattaataaatgatgcgcatatgagtgtccactagcagcatgcgtttcaaaatctgctgctcgttcatcaattggataaaaaccaattggtaaatcggcaaccgcgatatcaactggcttaaccattaatggttcaatcgcatcttgatggaataaagtggtgtctaacccttgtaactcactactaataccggctaattctagcagactatcatcgttatcaaccccaaaaccttggagcttattacccgttagattttgaatatgattcataacagttgctaataaattacctgtaccaatcactgggtccaacactgtcttaatttgatcagcgccaccaaatacttccgccaaatatgcgactaaataaccaattgcatcaggtgtcatttgtttattaggctccactttaacttgacgaagcccttttaaggttgccagttgtaaggcttgacgaatggtctccgcatcaaactggttaagcttaaccgttgcgtaaattgtttcaagttgtgcgacagtttgcgcatctggtaaattatcttcaaccttcacacgaccaccatcagcgatattggcaattgattcagtcaatgcatctaaataggttgtttctaaattctgttcaatcaacgttgttgtttgatcaattaagtcaaacaacgtttctacagcactcttaggcaattattttttacctgttatattttttatttcaaactgtttctgatagccattcttaagtgtcaccttgatttgatgctgtttccttagaattttactttcacctgttgtggctttaatcccctttaaatcagtcttagattgactagccaaggtcaattcataaagtgttttagcttgataatgattcagcaaataccgataactctgttgttgctgttgataactatgtgtcacacctactaatacgacgctaattaacgttagcattaatatcgcattaagtaatgcaaccgccgaatgtttaatcggttttaatcgtcttttttttagcctgttcatttaatcggttttaatcgtcttttttttagcctgttcatcttgttcctccaagaaaacttcgtgttggtagcgactctgatccgtaaaagtcgcatcgatttgaacaaacggtcgctgatagtcaagttgaagttgcttgaggttgcctaataatggcatatacccatctaattggctgacaacaaccatttcatttttcatcctttttaaatagtaaacagtctccgcttcctcccctgactgattagtgtctggttttcgaaaagtgattttggagccatcttgatcctgatgatgtgtaaaatacgcatcggctaaaaactgatctaactgaatcgtactgatatgccaattgattgtattttgctgttgttgtgtcactttaattgccttttgtaaaacacccaccgttgccaccagtaactgactcgtcaggattagaatcgccattgaaatcaccatttcaattagcgtgaacgctgaatgcttaatcggtcgtccaattaatcgcaattaatcggtcgtccaattaatcgcaaccgactcacctgcctttgtggttacctttaatttctgctgattagccgtcaccgtatagattgttcgccccatttgccagcgttttttcactgtctgatgcgctctcaactgctcagcggccattgctagaaccgcctgttgtgcaacttgctgttgtttaagcgtttgttgttgcttaaagtgtagtagacttaccgttaatagccagcaagcccctaatactaaggttaaggcgatgatattttcaacgagtaaaaaagccggcctacttctgaacatctacttctgaacatgtaataccccccacatcatctggactttatactgatattcacgatgattaagcgttgattttaactttaaggtgcgcggtttgatacccttattatgagtaatattaattaaatgccattcggctggattactcactgttaaagtttctggtaatacaagttggtgatttctaaacgcctcaccagcacctttaaatgtgatcgtatgtgttggtgcatcccacatcacacggacggcacgcggttcaattgccacatattgacgagctgcatcccaactcgtttcaaattgatgtagaaacaactgctcagcctgttgcgcacgatattgcttaatctgataaatcggcaaccagcttaataagctcacaatcgctaagaccacgcacatttcaatcaacgtaaaaccttcatttttgcttaaccgtgccgccttcaatcatttttgcttaaccgtgccgccttcaattgtaatccccttctcctttgcgtgctttaactgatcttttgaaatatacttatccgttagctcatctaaactcttgatttcatgaccaatctcgtcgctagctaattcaacttgcgtttgtaaagtcgtcaccaaagcttgatccgttttcttctccgcgcgctgtttttgagcacctaggtttggtgcaactaataagattaacaacgcaataatggcaagaacaactaccatttcgattagtgtaaaagcatttctttttttcttcattcatgaaattccctccattgtttgatacagcggtaataaaatactgagatacgtacaaataataatgagcccaattaagataaataaaataggttgtaaccagctcactttccgctgtaattgcttctgtagttccgtatactgcaggttagctagcatggtgatctcatcggtcgtctgttgcgtgagattatgcttagctaataccaatcgtaacgactgtggaaaaaatgcagagcgactaagataagcatccaatgattgccctgaagcgagtacgacttccaattgtgctaccaaggtcaccagccatgtattttgttgcagttgcttctgtaaagcacaaatttctgttaacttgagcccgttttgcagacaagtgctcaaatcaaataataaacaataatgataatactgctgaatatcacgcccaatgattggccacttgaacgctttttgtaatcgaactaaaaccggtaaccggcggtaaaccataaaaagaccgctgcccattatcaaaaggaccagcactaacaaaaagccccacaatatgacgtgattaagcggcgagcctgtctggtttgactcgggcgttatctgggcaatctcaggtaataaataatggcgtaataaaccgattaagccccctaaaaaagccaaaagaaataacggataagctagcaccccccgaatttctcggcgccgcttttgccgaatactttgaatctgacctaaatgccataaacattgcccgagattaccttgtaattcggttagttcaatctgaccaacataatcagttggaaaatcaacatgcgctaaactgactgctagactgtcgcctttttcaagggcttgattcacctgatttaaccactgtcgttgttttgggaagacaatcggtaagaaggcaaaagcttgttgcaatgaaaaaccgttctctaatagccgccccaataactgcaagaaatcagcgtaaaattgcgcttgttgtcgtaacttatacatttatacatcgcaaccaccttctttttttgagaaataatctggaccagttaataattcataatgggcttgcacaacgtcgtcttttgtcaccaacgattggtaggcaattcccgttagacaggcccgcaattgcatctcagaaatccccagatccaataagcgcgcgaccacgccctgtgtactccgagcgtgaatagtactcaataccaggtggccacttaaggccgcagaaaccgcgtattgggctgtctctaaatcgcgaatctcaccgataatcagcgtatccggtcgcagtcgtaaactaatttttaatagctcggcgtagctcaatcccgcattatcgttgacctgcagttgcaaaaactcaggtgcaacaatttcaatcggatcttcaatagcaaccaccatcttggcactcattgattgttgggccagatgatagagactagtcgttttgccagaaccagtcggcccagcgaaaagaattaagcccgcctgtcgactcatctgcgttaattgcgccaagatctgttgatcatcacaatgatagatggcaccaattggatagataaaccgaatgaccaagctttcgcgatttaaaaaatccccgaccgtcgctaggcgtaaataaattgtttggtcggctagctgtaattccgagcggccggtttgcgcacgccgagtctcgctgatatccatccccgccatatacttcagtcgatttaaataacgcgttccagtcggtttatccaattcttgattggtgaccaaatcgctctgacgacgttccgtcaagcgccagccacctattgtcggtgtaaaataaagatcttgaacacgttgtttagcacaatgctttaataaagttgttagcttttcttcagttgacatttattcttcttctggtagttcaccagcagtataaacatcttgaacatcatcgttgtcttccaaagcatcaactaaacgttggaattgttctactttttcaggatcaactggtgttgtattttgtggaatcattgttaattcagcatttgccaaagtgtatttcttttcaagaatatcacggacatttgccaattccttaggatctgtgtaaatttcaaacacatcttcttcggtttgtaaatcatccgcaccggcttctaaaatgtcttcgaacatttgatcttcatcaacatctaagccttcacgtgcaatcgcgatataaccgcgacggtcaaacatgtaagccactgaaccagcagcacccattgtcccgccattacgagtaaatgcaacacgaacgtctgaacttgtccggttcttattgtcagttaaagcgtgtactaaaacggcaacaccacctggtgcgtagccttcataagtaatttcgtcgtagttcgcgccatcgctaccgtcagccttatcaattgcccgtttgatgttatctttaggcatgttagctgaacgtgctttatccataattaaacgtaatgcggcgttagaacttgggtcaggaccgccacttctcgcagccatgaaaagctcacgggatagtttttggaaaatcttgccgcgttttgcatcttgtgcgtttttacgaccctgaatattatgccattttgaatgtcctgacatttatcgtcgttttttacgacctgtaaagtataaaataacactcataatgacaatccctgataaagcgcccacactatcgagcatgacatcttgaaaaagtggtgtccgatcacccgttaacatttggtggaattcatcagtggcggcatacccggtggcggccagccaactgaagatgcccgctaagaaagtgccttcgattcggggacgtaatcctaaataactaaataacgctaataagaaatatgtgccgaagtgggcacccttgcgcacaaagaattcgacaaacttaaaataaccacttgccttaacactttgttcattgcctgcataatggaaggagaattgactcaaccactgcttgagtggttcatttttcaagacgcgttccaaaagtgggacggatgtttgttcatgatacgtcattgatgagctataaaacaaaattgccatcatgacaagtgccaatactaagaaccaatcgctctttttcttaaacatatgcccgagcaagatcgtttttaccaacctcaaaacgccaaagatgccatgcgttttgtccaaaaattattcaaccaatacaaccaagcaccgctaactgaagaattagtcgcataccatcaaaaattactcgcttatctcaccaatgacgtcaccgctgaagtccaaaaacaaggcaactcagaacaagctgccaaattaaatggcatgattgtcgccatgcaagactggctaaaaattcgtgtcagcgggaaaccttacgctggcaaaatgcaacatttcaaatttatgcctgatcaacaacaaacgacatttaagcaacggacaattaaaggcagcaagcccaacaacctccggacatcgcctcgtcgttaattagtcatcataacttgctgatgcatcaaactcacttaatctagcagcatcaaccttctcagcatttaaatagtctgtaaacttcgctgatttaataaagcccgtcccgggatttagataaatattgccatcttctcctaaaccaattaattcaacgccatcaatctgttgttcatcttttggtgaaacatcttcaatcgtcgtcagataagcaaaccgaatccccccttgtgtcacgttactatcagtcgctttaattccaaatgcttgggggcggccccacatacctgctaaactcggtgtccgataggcaattaacgcccacttaccaaaattttctgcattttcaaattggctgataagcggattaactttagtcattgtgcctcgtttttcaagataagttggcgttttggttgctgattcagtcatcactgtacttgttttataagcccctgaatccggtgtttggtacgctgcttccgacccaccgaccgaatccgatagccgcataataagctgattatcataaaccgcaaaattaaagcgttcatcaggcactgacacacttgaccgatcacggtactggttacccgcaacactcaattgactcatgttataaacatccccctggttatgatcaaaagtaatatgaccctgatcatctaaatggtactgacccgtcatataggctactgagccagcaccataggaattgtagactgcttgccagttaaaagtaccatcttgattaaaggttagccaaacctgattcttatcaattcggcccataaaattcttaccaccaatcaacttttgcgcgaccactttcggtgctgattgatattgcttagcttgttgtgtcttgaattgatcgaaatcaaccactttagttttcactttatataatttaaccttattaattgaaccttctaaatatttaggcgttattttaatttcaattggcttattttcagctgctgttaactgatgttcgtccctatattgatatgcagttggcgttgccttttgtttaagcgcactatcacttgcgtaagtgacttcaactactttttgaattttaatgataatctgttgcgtcttcttattcacctgataggtccctgattcaacaaacttaccagcatatccgttactggcggtaatatcttgccggaatgtaccatcttttttaaagctcattaaataatcataatctggatcttcatgagacttattccccatataattcccgtgataagtgccaccgctaacattattttgtgttgtagtttggtgttgtgcgtgactaatctgtttagctaacttcacttggcgactacatgccaccaatagtaagctagcaaatgccagcagcattactttcatttttttcatctagtcatgaatatgtgtcggtgcgattgttgtcgtcccgataacccgcatattttttaaatcaacaatttctttttcgtaatctgttggattggcgcccggaccttctcttataaagccatatacagcaacgtcaccaaagcgtctgatagcgggtgtggcagtgccttgaaagaacaatttataactaccatcactttctaaagttattaccgcatcatcatcaacgccactattacgccagacacgccacattacattcgttctttttccaaccaatagattatacagttcaactcccatattcgtatcaataaccgactcactcgtcacctttaaactcggatcctgccccgcaacttctgccttcaactgcgttaattcactacttccagttggtgcagtttccacttttgtggtattcgttgtttgacgcgacgtgctagttgtcgtcttacgacttttttgcgattgaacttcattttgcgcggctgtcttaaaatggttgaacgatatcatcgcatgttttgttggtcgcaactgaacgccattaacacttccctgtaaataatccgacttaattagaatattaatcggtttatcctctgctgctgtcagagtcttgcccccttgttgtttacgataatcataactaattggtggctgttgatgggataaatcatattcagtcgcgtaagtgacttccacaacttgctgaatgttaatcacaattttagctgtctgcttatcaattgcgtaggtcccttgctctacaaacttggcataataaccatctgttgcagtaatatcttgtctgaacgtcccatctgctttaaacgccattaaatactcgtagctggggtccgtcttcgtaccagccccttgataactacccgcaaagttctgtccaataatcttaatccgaccatttttagtagtaggtgacacgacatgttgctctactttttttgcatgcttagtgttgtcctgacaccctactagtcccaccattagtagtaagaaagcacccatatgactgataaaatttttacaaaagaaacactcgcacaatataacggtcaagatggccaaccaagttacgttgctgttgaaggtatcgtctatgacctatccgcaatgggaccttgggaaggtggcaaacattttaaaggcttgagagctggacaagacttaacagaagccttcgcaaactcacaccacacacctaaacgacttcaaaatctccctcgaatgggccgctatgaaggttaattagaataggatcgtaattaataaaatagcagcagcaacttggaaaacgactaaaccaccggcataaaataacaattgtttgccttgattaaatagtgtttttaagtttaaacgtaagccgattgcggctaaggcggtcatttcacaccacgtactcaagaaatggcagattgttccgaattgacctgggaaaagatgtaggctgttgatcacacaaaagattaaaaagcctaaaacgtaccaaggtactaagctactctttttagccaatagttgttgacttaacttcgtatcggttgcttggctttgtttcttctgatgtaaataaccaaaaccggtcactacaaagactaaacagataattcgcaagattttaaataaggttgctgtgacgacagtgccttgattaatcatggtcgcactggcgaccacttggcccacagattgcaccgtgccaccaattaaaatccctcgagcaagattatcatggccccataacagtgtccctaaaactggcagtgccaacatcaagattgtccccatgagattgaccattgtgatggcaatcccagtatcttcattatccgcatcaatcacgggcgcaatcgccccgattgctgaagaaccgcagaccgcattcccaccggccatcaataagtacgtgccttcgctaaagcgcaagcgccggcccaaccagatggcaaagccaattgttaaactcatctgcaagaccgttagaacaaccccttgccagccaattttttgaatactttggaatgtgattgtcgcgcctaataacatcaccgaatattccaagagtcttttttcagaaaattttgtgcccgcggctaagcccggttgttttaaccaggtattgcctaaaataatgccaacaaataacgcgatggttgcaccacctaacattggtaaccataattgtgcaatatagtagcttccaatcgcgatgaccaatgatacaataaagccaggtaatttcttaatcaatgattgcatatgatgtttaaaacgctcgaaattttcaagacggtttatgaaactaaaaattttacgactgcggcccaactccttttcctgtcgcaaccaaccgtttcagtgcaaatcaaacaacttgaagagtcgctcgatgttattttattcgaacgcaatggtcgccaacaaatcgtacccaccaaacaggcggatttattctacgagcaatgccagcaattactggatttatggcaccaagatctccatcaactacaacaccaagaaaggcaggctaaaatcccctgccggattgctgcttcacacaccacggcggcctacttcttaccggcgttacttagtcgccaccgtgctgctttagatgctttagagattgaaatctgcacgttaaattcctcgcagattgtcgaacagttatcgcaacacaaattggactttggctttatcgaaaaaccattaacggaaaaagatatcgttcgcacgccgctacaaacggatcaattagttttagccggtcaaccaaccgaactgtggctcttacgtgaaaatggttctggcgtctatcattacacgatgaattatttaaaggaaaataatttaacgctcgataacgtgatgacggttaaaagtaatgccattatcgtccaattattacgacaaggattaggccaatcattgatttcaagtgccgcattacttgattatccagagattccctaccgaccgctttccaaacagtaccaacgccaattttacctggttaatcgcaagggtttaccccaaccaatccaggatttcgtcgcgacattactggcgaccccactaccaattgaatagttgacaaactcaccacagattaaaaaagaactgactggttacatcattcgtgatgttttcagttcactcggcctttccatctatattttggccgatacctacttcatcgcttacgcggtcggcccaattggcttggccgcgctcaatatcgatttacccctttttaacctttttaacggcttaggattgatgctcggtattggtggcgcaacaattttctcgattaataaggttaaccatcccgaaaagagtcaggcgattttcactgaagtcctctccttcggaattttattggggctaatcatcatgagtctcggtttgatttttattcatccgctcctccatctactgggtgccaatcacgaaacgctcgggcctagtttagcttacctacgcgttattttaattgggagtccactctttattctcaataatttggttctcagtttcgtgcgaaacgatagcaatccacatctaaccatgattgcgaccctttctcaaagtttattcgtgattatttttgactacttattgatgttcccactacacatgggcatgatgggggcggctcttgcaacgatttgttcaccgctcgtcagccttttgattttaacgcaacatcgtcatcacccggaacgcttactcaccctcaaaaaactcacgttaaacttcaaaccaacgtttaaagctgtccaattgggttttccttctttcttaaccgaaatgagtaccggcgttagcattttcgtcttcaacatcgttattttgcatttagccgataactacgccgtcgcagcttacggcattattgctaatatcttacttgtcggtttatcgttatttaacggtgttgccgttggggtccaaccaatcgtcagccgtgaatttggtaaacgaaactggcataacgttaaaactagtttaagaatcggtttgttatcagcactcgggatcgcaactggtctgtatctggttttacttgggtttaaagaaccgatcatcgccattttcaatcatgatcacaatcaattactcgttcattacgcggccgctggtattccattgattttcatcagctttttcttctcaagtatgaatatcgtcaacaacctatttatgacggccattgcccaaccacgactatcatttttcgtcgcgattatgcgcgggtatgtcctcttgattggcagtgtcttattattatcggccttgtttggcctaacgggtgtctggctcagtgtgccgctcaccgaattagtggtcttaatcggcggcttcttcatcacacacagcttattgaacacgcttggtgaataactattttaattttgcactcagtggtttctgtggatcgaccggttgttgcacaattagttcctcaatcaaataaacaatcgtttcattttccggtaaacttgtgtgtttggcatcattaccactcacaaacatcgacatgtaatgggcaatttgattttggaagacttcccgacctgccgcaacgctagaagctgggacaatgccatcatccccaccagtcgttgtgccaccaacggaatagacaaccatttttttagaaaggtgttctttttgagattttaaatccgttaacattgggctttcatctttgatgctggcatttaacccattatagggtgtgccaatcgttaataaacggcttaattgcgcctctttaggatagcgttccgcataccgcgttaacactaacccgccgttagaatagccaacaccattaaatttcttaaaatggtattgcttagtcagctgttgcattgccttttcaaaccattcagtttgcttaaagacattctcgtccccgtcattattgttttcaaaactgaccacaattaaagggactttatcgcgccaaacaatctggcccttcgttttgacttgaccatccgccatcacttccactttaagaatactatgttggcgataatgttggttaactgttttaaaaagttgatcgaaccgatcattagtgccaccactgccgggtacaaaaacaatcggttggcgatccgctttttgcgggctaaccaggccttgaaccgcaactctagtggtacccagtgtcccaattaccccaccaaggactaaacaaaaaacacaaatcaatactattcttaattttcgcatttacagcttgtcattaattttagttggtaaaatcatttgaatatccgctggaatcggcgctgtaaactgtcttttctgttgactgaacggatcattaaaggttaattggtacgcatgcaatgcttggcggtcaattccccaatcaagtgggccttcataaagctgatcgccgaccaacggatgatctaaatcactcaaatgaacacgaatttgatgtgttcggccggtgtgaatctggacttttaagacagttaagcgctcatcttgtgctaaacgccaataatcagtccaagcactttgtccgtcagcaatcacccgccgacgtggttcaaccccgacacggccaatcggtgctttaatcgtcccaaattcaggtagtccagtccccgcaacaactgctagataaaatttttgcaattgatgttgttcaatctgcggttgaagtaagctctgggctacttggtgtttagccgctaatacaatcccgctcgtgtcaaaatcaagacgggtgataatatggggtactaaatcggtcgcgccattttgttgccagtaacctttgatccggttcaacaacgtatctgtcgtattagttggtccagggattgttgccaggccagccggtttgttcacgactaaccagtagtcatcctcatagagcacttcaatcggtactccactgaccgcgaccgtttcgtcggctggttctgcaggtaatgtcagactgacctgatcgccgttttgaacttggtcagcgggactgcttaaccgattatttaagcgaaccggtagaccctgcgccttaattttggcatataggcgctgactaatcccattttttagaaggaactgtttcattgtttgtgattgttgtgtggcgacttgccatttaatttccatatgacaaaaaatgtagcagttttaattggtagtttacgtaaggattcatttagtaaggcaattgccaaacaattgatgccgttattcccagaagacatgcacttagaggtaattgaaatcggtgatctcccactttacaatcaagactatgatgatcttgatcaagtgcccgaagcctacacgactttcagaaataaaatgcaacagatggacgccgtattattcgtcacacctgaatataaccgctccgtaccggccgtcttaaaaaatgctttagacgttggttcacggccttatggtgcgagtgtctgggataacaaacctgctgaaatcgtcagcgtttcaccaggtgccattagcggttttggcgctaaccatcatttacgccaatcactcgttttcctaaacatgccaacagttcaacaacccgaagcttacatcggtaatgtaatgaacctattagacgacaatggccaagttgctaatccagatacaatcgccttcttccaagtgattgttgatgcatttgttacattgattaaccgttatattgactaaatggcaaagaaacaatattcactaacattaatcggctttggtttagcggtattagggtttcttttttcgcttccagcggattttggattggggcttattataccatcactacttgaaatagcaggattcgtcctatcaattattggaacggttaagaaggatcacagaaaattagcgattaccggcatcgtagtaactagtttattacttctgatcttcatcctaggatctgttgcaaataacgaaattgaaaaggaacaatatcaacaagagcacccaatttcatctttaatgcaacaataattaccacttagtcgcattccagatacggccgtccagttcaccctgacgttgttcaatccgagttgctaatgctcgattgagttctgcgagcgcttcatagaaggcttgatcctcatacgtggttgcttgttgtttgagtatttgaatttgttggtttaaccattcttcatttgtcatttaaccttcgccttcttcctggcgaatcagttgcacttgccaacctaaatcggttaacaattcaccttgttctgccaactgatcagccaataacgccagctgttgctgctgctctgaatcagtcgcagccgattggcgttgtcgcaactgctgttcaaaccacgccaccttttgttcaaagttaaaagtggtttgcgttaaataccgctgataatcaactaataataattggcgggctgtttcggttaaataactaaattgatgaatcgcaagcggcggtaaataggtcattcctaattttcgtgcgactaattcatatggccgtaaaatttcggaaagcgttgcttgctcgctgccaccagcttgaaaatgtttaccagcaatccctgtcgagacaacaacccccaacgatttcccttgtagcggcatccgcccgctaaacgcaaattcaccagttaaaacagtatctaaccacgttttgagactagccggtgcagcataccaatagagcggaaattggaaaatgattcgcccatggttgcgcaataaggcttgctctgcggcgacatccagctgttgaatggttgctaaatcgtgccaagtcacttcatcttgaaacggtgtcgcactcgccttcagaaaattctgaacaagcgagttggccatttcaggatgactgacaatcactaatgttttcatctaatagagttccaaatattgctcacgttcccattcagaaacttgttgacgataggctgcccattccaatgacttagaatccatgaaactttgatagagataagtgcccattgaatctttaataatatcatctttagctagttctttaagcgcattgtgcaaggttgatggtaaatcagtaatatgattttccttccgttctgtttcatccatgctgtaaatgttacgatcaacacctgcttctggtgaaaggccttgttctaaccctgataaaccagctgctaagattgaactgatcgcaagatatgggtttgcactggggtcaacactccgcaattcaagacgcgttgataaaccacgtgattgtggtactcggattaatggtgaacggttatggcctgaccaagccacataaacgggtgcttcaaagccaggtaccaagcgtttgtatgaattaacagttggattgttgatggccgtaatcgcacgagcatggcgtaataagcctgctaagaagtgataggctgtttctgataattgttctttgccattttcatcgaagaaggcgtttgtcccatcttggttgaataacgacatgttgatgtgcatccctgagccattgacaccgtgtaatggttttggcataaaggttgcgtgaagcccatgtttacgggcaattgttttaacgactaatttgaaggtttgaatattatcggctgcatcgactgcatcggcatacttgaaatcaatttcatgttggccaggtgcgacttcatgatgactggcttcaacttcaaagcccatcttttcaagttccaaaacaatatcccgacgacagttttcgcccaaatcaacaggggcaaaatcgaaatagccaccttgatcgtttaattttaaggttggtttgccaatttcatctaatttaaagaggaagaattctggttcaggcccgatgttaaaatctttgaagcctttatcttgcatttcgcgaaccatttttttcaagttattgcgaggatcacctaagaatggttccccatcagcagtgtaaacggaacagattaaacgagctactttgccatgttcagcttcccatgggaaaatcaaccaagtacttaaatcaggacgcaaatacatatcactttcttcaatccggacaaaaccgtcgattgaagaaccatcaaacatcattttgttacttaaaactttgtctaattgactgattgggacttccacattcttgataatcccattaatatccgtaaacattaatcttaagaacttaacgttttcttgatccactaattgcttgattgcttctgctgtcaacatttttcgtgccatttaatataatttagatgattgtgaaatagatggtcgttgtcctactaatccgccgaccgaaagcatttcttccgctaacaattgacgggccttggtatcggtcagatgccgctgttgcattttttgtgcttgcttgcggtaaatctggcgaatttgaaccatcgtggcaccttctgctaaataatccttaatctctaataagcgatcaacatcattcagcgaaaataaccgttggtgccccggcgtacgttcaggcaaaacaagttcttgactctcatagtaacggatttgacgcgccgtttgaccggttaacttcatcaccgttccaatcggtaaaaccgctaaatttcgtcttaattgcttttcagccatctagtcttcatcaatcagttgaattaagccgcccgcaagcataaataaatgcgtaacgacgggtcccacaaatttaaagccccgtttctttaagtctttggcaagtcgggcactaattggcgctgatttatcggagaccccagccatttgtgaatcaagtaattgaggttgattgtcaacaaacgcccacaagtacgctgagaaactaccgaactcatcctgcactttttgaatcgcccgcgcattctgaatagtggcgcgaatctttcttgtattgcgaatcatatctggtgcttcttgaagtcgctcaacatcaatttcatcaaattgtgcaacccgatcaatcaccattcccgccatttgttgccgtaaaattggaattttactagcggctactttccaacttaaacccacctggaaaacaccaaccgttaagagttcaaaccaaatttgatcatcatcagttggcgttccaaaatagcgatgataggcttgaataccatctgtcgctattttaaaatcatttttcgctgtctcatctaccatttatttttcaaagaatgttgtttgtactgcccgactaatggcgagtttaacgtgcgcataagttaaaccaccttgtaaataaagcgtgtaaggtgcccgcaatggtccgtcagctgaaaattcgatgctggcgccttgaataaaggtgccggcagccatcacgatttgatcttcgtatccggcaaagtcacttggaattggcgtgacgaaagaatcgattggtgattgtgcttgtacacaacccgcaaacttaaccatgtcatcagggttaccaaagttaactgtttgaattaaatcggttctaggggcatcccattttggcgaaacgttcaagcccatttgttccaaaagcgctgcttcaaaaacagcccctttgatggcatttcctgtaacacttggcgctaagaaaaagccttcgaacattaattgtaagttaccttgtgtggccccttcactggcaccaacacctggcaccgttaagcgataaccaatcatttcaatcaagcgttctggcccaacaatgtaaccacctgtttgggcaatcccaccaccagcatttttaatcaatgaaccggccatgacatccgcgccgacttccgttggttcgattgtttctgagaattcgccgtaagcattatcaacgaagacaatcaattcgggattaatccccttgataaaacgcaccatctcttcaattttagcaaccgtaaaactatcgcgatcggcataaccacgtgaacgttgaatcgcaacgactttcgttttagccgtgatcttcgtcttagctgtttcaaaatcgaccgagccatctgccaataatggcacgtaatcaaagccaatttgatattccttcatcgaaccaataccgttaccggccatcccgacaacttcttggagcgtatcgtaaggttctccggtcagatagagcaaatcatctccagggcgtaacatgcccaataaagctgttccaatcgcatgtgtgccagaaaccagttgtggccgaacaagggcgtcttcggtcttgaaaaagcgactatagaccgcttctaacttatcacgtccttggtcatcgttcccataacccgttgttccgtttaaatgtgattctgaaatattttcttcttgaaaggcttgcagcacctttgcttgattattaatgatttgttcatctaaggcttgaagccgtggcgcaatttgagcgtcaacagcttcaattttggcccgtaattctggtgctaacgaatcttgccaattcatctatttctgtaaccaggtttggatatctgcttggatacgcgctaagtctgcttcttgatgctcgactagattataccagttaaccggaatttggtttctaaaccacgttaattgccgttttgcataatggcgcgagttttgcttcacttgctcgattgctgcttctagtgaacactcaccatcaaagtacgggaagaattccttataaccaatgccgcgaactgcttgcggacttgttgcacggcgttcataagcccatcttgcttcttcaattaatccggcgtccaccatttggtcaacacgctggttaatccgctcgtacaagacaggacgctcgcaattcaagccaataataaaggtatcatagcgcaactccttaggcttttgttgcgagaataaaacacccgttgtttcataaacttctaacgcccgaataacgcgacgcgtattggccgctggaatttttgccgcagcatctggatcaatcttagccagcgcctgccataaatcagtttctgaatgctgttctaagtatgcttgccatttattgcgaatactgaaatcctgttcagcatccgttgcacttcccagcgtcatatcatacaacaaagcttgcaaataaagacctgtcccaccaacaatcaacggtagatgttgacggtcagtaatttttgtaatcaactgttggccttgttgttgaaagtcaaaagccgtgaaacgttcatcaatatcagcgacatcgattaaatgatgcggcgcaatggcttgttctgccggcgttactttggccgtaccgatatcaagatgacggtaaacttgcatcgcgtctccagaaataatttcgcccttcaactgttgtgccacttgtaggctaagtgccgtcttaccaacacccgtaggccctacaatgacaattatcttttcttttttcatatgaaacataaattttttaaaggtttcgtaatcgggactgtttctactgttggtgcgattgccggttcactctttgcatttaagaaaaccgtgttagatcctatcgaagaagaagaaaataaaatcgaagaaaatcgtcgtcgcgctaaccgtaagagccattcagctcaccaaggctaactactttttacgttttgtttttcctgtccagttgttaaaacctttttggagccatttaacgttcgtaaaacctgctttgcgaagttttaatgctgcacgaacgcttaatgtaatgcctgtatcatagaggtagaccggcaaatccattcgtaattcacccatgttttgctttaacattgggtaaggaatgctccgagcacctaagatatggccagcatcgaaatccttgcgttcacgcaaatcaacgatttgggctttacgcatgttttcttcaaatgccttttcagtcagttcgccgcctagacgcttacgttggattttatagtaaacccacacgccaattatccataacaaaatagcgatcaagataatattaacaacaaacattggattaattgtcccgattacaaacatttattgttggtcaaattgtaaagctaatgaagcagcaccgataacaccggcaacgttacctaagttagctaaacgaaccttcgttgtttgcttaacatttgggaatgtaaattcttcaaagtaagcttcaacttgtttacgtaagaattcaccagcagctgaaacaccaccaccgataacgatgtaggctgggttcaacatgttaccaacgttagctaaagctaaaccaaggtagtatgacacgcggtcaaccactttgacagccaaaggatctgattccttagccaagtcgaaaacaagttttgaactgatttgttcgccatcatctaacattgttttcaattttgaattaccagcatattcttcagccatgtcacgcgcaacacgcacaacacctgttgctgaagcataagtttctaaacaaccttttttaccacaagtacattcgtaaccgcgtggttcaacagtcacgtgacctaattcaccggcagaaccagcaacaccgtgtagtaaatgaccatcagcaacgatcccgccaccgacaccagtaccaagtgtcacgaaagcaacgtcaggttggttttcaccagcacccttccagcgttcgcctaaagcggctacattggcatcattatcaactgctagtttcatatgtgtgccagcttcaatatcgcgacgtaagtattgcgttactttccagtttaagttgaaggcaccaataacagtaccttcttcactgttaacactaccaggtgttcccataccgattccgatgaaatcttctggtgtcatgttgtataaatctaaatgatgattaatcgattcaacgatatcgggcacaatgtggctaccttcatctaaaatatctgtatcgatactccaacgttgttgaatgtcgccatccactgtcataattgcaaatttagccgttgtaccacctaagtcaacgccgattaacttcttgtctgtcattcatttaaacttttcctccaataattcatgattgaatgtttgtttttcttccaaccgatgttcatgtactagcaccatcttagcgtcgcgatacactttaccatcgattaaaccagcatcgtagacatgacgtaactcgatactcgttagctcaatatcccaaagtcgcttaccaacatggacataaacaccaaattgttttaaaagttgttgtacatcataaagtgttctcatttaacgattcatacccaagtagacaaataaaatgagggtaatgacgtaaattaacccactaaccacacggtttagcgggttaattttcccgatacgtggtgcgccaagtgccatactacttaaaaagccacctaaaataccgccaaccatcccgtacatcgcattacgattaacgacaaattgtaatccggctgttaaaaataggaataaccaatactggcgcgcaatctgaccaaaaactggattatctttgaacgcatcaccaagcattaaaaaaccaccaaaaatcccaagaacagctaagcccgctgtaatcgtttgcgaacctgttcctaagaaaaggccttgtgtgattaaacttgctaaactactgagtatatagattgctaataagcgccaatgaccaattaatgattctaattggctcccgacaaaatataaaataacacaatccattaagagacttaaaaaactaatatggttaattgaagccattaaaaatgggacaacaccacctgccagcaagccttgcaccgacgtaattccctgcgcccaaatcattggtgcaacaaacattaacccaaaataaaggacgttcatgataatcaaagcataagcgacaaatggtatttctcgccaatctttggtagtatgatttactttcatttaagccgtaataatgtgctttagtttaacatcaaattgatcaactgaccaatcaggcaccttcacttgttgtggctttaaagcgagtgcaacattgttcatctgatgcgctgccagatagcgatcataatacccaccaccaaaaccaacacgccaaccgtctagactaaagacaacccctggaacaatcattaagtccggcacaattggctcaccagttatctgcggctctaatacgccaaaatgacttctctcaaggaccgttgttggtgtcaactcataaaaggccatctgacgcttaggcaaggttctgggcactacaatccgcttaccagccgcttgtgcagcctcaataatcggttgcgttgcgacttcaatcggttgattaagcgtcattccaatcacggttgcggattgaaaagccgcgctgtcaattaatttttgtaacaagattgcttcttgttgttgcttgttagcgggttgttgggctaaacgctgtaacgctgccaaaccctgttgtcggacttgttgcttagtttgcacctatttagtttcgcggtgtaaagttactttgcgttcgcgtgggcaatatttctttaattccaagcgatctggattgttacgtttatttttgtttgataagtaactacgttcgtgacattctgtacattccattgtaatgtgaacacgcattcattttgaaatattatttaatttatagtaatcggtaatcatttcacgcgccaacaaggtattgtagtgcccttcatcggatgtcaagttagggaaaacaatcgcgatggcgacttgtggatcattatatggggcaaacccaacaagacttgatgtgacggtttccacttgcttgctgtttgaatcattaggatcttcacgtgcaaatgattgcgccgtccctgttttagcgccaaaggttggtttgatatctttcaaggtatgcgctgtcccccaggcattagtcccgttgacaacgttatacatcccttctttaaccacattaaagtacgattttggtgcgttaatcgtgttcaagactgttggactagtcttggattcgagtttacccagattaccatcagtccctgtttgttggattgaatccaccaaataaggtttcatccggttaccaccgttagcaattgtcgaaatatattgtgccaattgaattaaggtataggcatcgtagttcccgtaggataaatccagtgcggaaccagaagctgtattaccctcagccgttaaggttggtccttcaatcccctttgtttcacctggtaaatcaattccagtcttttgacctaagccaaattgattgaagtatccgcgcattttcgtaaagatatccggtgaaatatgaatttcttgattcggcacatacttagctttcccttcacgtaatgctagttgcatcatataaatattggaagaaacttctaaggctgattgtgctgataatgaaccgaaagtccccactgggtaaacagatttcttaactggggtccctggtaaataaattggcgtatctggcaaggtattattacttggtgaaataacaccgtccatcatcccgcccatcactgtggcccctttgacagcagaccccatgacgaaggtgcgattgataacccctagcgcgtcatcactggcttgcttagtagtacggtcgttttgttcaccagccatcgctaaaatcgcaccggtttttggattcatcgcaaccgcgtaagcaccgtcagagtacgtcgttgcgccagcggctaccgctttggcatagattttcttcaaggctgcttccacttttgtttggtaggcttgatcgatggttaagtttaaattacttcctttttggcccttgaagagcactttgcttgagagaatttggttgttattaccaacttccacttgggtttgtgatttagagccatgcaaaatactttcgtattgcttttctaaataacttgtcccaacccggtcgtttcgtgaatagccttgggctaataacgaattgataccgtcttctggtaatccttgttcttctgttgaaacatgcccgataatactgcgcattgaatcaccgttaggatatgagcgttcccaatcggtcccgacattgatcccaggtaaactggttaaatgttcactaatttcagcaatttctttatccgttacattgtcattcttgatgtaaactgttgagagttgataagcaccactcatgattttaaaaatcgctgcggcttgtttttgcttatctgataagccagtaaatgacttttcaacaagatcaattgttgattgataaaccgtcttatccggaattttagaaccatcagccgctacttttttagattttggtaggcgagcattccattttttaagattcttcggattgctgaggtaataatcaatctgatcacgttccgtcaacgtatccaacttatcgatggttagatatttcgttaactgattggcctccgcatacattttatccgccaagacgttcatattcttcgtatacgtaatggctgatttagcactattgccgaccaacacacgccccttggcatctaaaaccatcccacgagggacattgcccgtcacgatttttttatcggtactattgaccatcgcctgataactcgcaccatttaaaacttgcaagcgccccaattgaataatcaaggctgcaaataatgcaaaaacgataaaaaataggaagttaagtctgaatggaatatgggatctctcccggtttctcttggtttttttcttcataattttcacggacaagtgactcgattatacacttttttacgacgccactacgcgttaggccttagcttcttactcccttttgccattatttttatttatggcttaagtcgccacgtctttccgtttggcggacaaacaattatgacggttgatttagggcaacaatacatcgatttttttgcctattttagaacgaccttacttcagcatcccgataccttcttttattcatttgccaagggacttggcggtgatatgctcggcgtttgggcctactatttaatgagcccgtttaacctgctcgtcttattgacgcctggtaaatggttgagctttggcgtttggctcatggtattgctcaaatacggttttagtgggctgagttttgcctattatctcaagaaaagtcgtctactaagtggttggtggctgccaacactcagtctagcctatgcactatctggctttgcaattgccaaccaatttaacgtgatgtggttagacgccatgatttggttgccactagtcgttttaggcatcgaacaactctttgagcgtcatcgtttttggttatacccacttagcttagcggccttattgattatcaactattatatgggctacatggtttgtttatttgtgattgcttattttttctgggcgagtgtccatcattttaaaacttggcgccaaacttgcctcgcctatctcaaatttgccggtggttcaatcctagctggcttgttagcggcttggctgttattaccgactttcttccaattaacacaaagtaagggccaatatacgattcaaaagattcactggaaaattgaatataatcccctcaagattctctctaaattggtggttgggaatttcaatttcgatcagatgccaaaaggcgaacctaacattttcgttggcagtctcgttttaattggttttatcgcctatttcctaacccgtagcattccgattaaagaacgactggccgcattactagtgactggttttctcggattatcactgtgctttgaaccactcgatttactctggcacggcatgcaattcccagtttggtacccttatcgtttctcttacgtgattagtttctggctaattgtcttagctgttcagcgattgcattatcagccacagtttaagtggtacagtttgctagcaccacttttactactagcggcatcacttgcttatactttcaaacacgtcaaaacattttcggcgttatctgaacgacaagtcctccttagcgttggttttttaatcgcggtcagcttaattttaatgttgccagcacgcttcaaacgctatactgccgtctttttattactgattaccggtggcgaaatgaccgccaatgcagttctcagcttgaatcaaattagctacgtttcacaaaaggattacgctgattacaccgaacaactgcaatcagcagtcgcagccgtccctaataaggtgccattccaacgcattggtaaaacgttcatgcgaactaaaaatgatccgatgcaagccaattatttcggcggttcccactttaattcaatgttggaaccaagctatcctaaatttatgggcagcattggcgaaccagctggtgatggttccgttgccgataccaaccaaacgatgttcactgatgcattattaagttatcggtattatttaaacagcaccagcgtccaagcaaccgtgccgcgcagtaccaacaaacccgatttaagtgactatcgccaaatcaagcaaaacggtcagattgctatttatcaaaatgataatgcgttaccactcggttttgcggcttctgataaagtgcttaagcataaagtcacggcggactatccgattcttgaacaggggaacattgcaaccaagctaacggataatccaacacttggcaatcaattatttacccttcaatatttcaacaccgtttcttaccaaaatactaaacaaaaaccgaagttaaacgaaaccttcctccgcattaattctaaaaaagatgcgcacgtgacctacaccttcacgccgacgacgaatgacccttactatttaacactgggctcaagtctcgagaagaatgctgtgcgcttgacgttaaacggtcaaccgattacgcaatacgatacctttagagatacggttgcacttaacttgactaacaaggcactcgggaaaccacagacgttagacatcgccttttcaaaggatgaaatttggcttcaaaacatcaatctctacagtcttaacttggaaacattaagcaagattacaacgcaattaaaacaatcaccgttacacatcaaacacttttcaaatacccatatcagcggtgatatcacgatcaagcacaaggatcaggtcttaatgacgacgattccttatgcccctggctggcaagtaacggtcgataaccaccccgtaaaagcagtcaaagggctcaagaacttcatcgcagttccattaaaagcgggtcatcaccaaattgaactgacttaccggccaccttatttcaaactagggcttctaatctcagtggtatcaggactaatggcaatcttaattgcgattataacgcgctattttagaagaagacgattattttaattattccgtatccgtgtccgccaagatcaacgcgttttcagcgtagttaatatctttgcgtaactcatccgccaattcccatgaaatcttatgctgttccaataattcttgaatcgcaagtcgttcactcgttagcgccttgattcgtaatttttgtagttgttgttcgtaaatatccgtcttcgtatggccgatatttttcatattttcaatttgattccggtaacgaataataatttgataaataacttgccggttataatgatgctgccggttctcaggttgtttcaagaaatacgacagttgtttgatgcccgctttagccatttccttttcggtcgttcgccattcagtgagcgccgctgtcgatttctgcgatgtctttaatctcgctatcaatcgcttcaacatcgtcaaacctctataaaacatcaattggacatgacgccaactgaaattactgccaatcaccgacaaagcaatttgtttttgccgtaatttccgtttaccacgacggtaagttttggccgtaatttcaccatcagaccgcaatgtttctaatttttgccgttccccttcaaaggcaacctgccgcaaaattaattcttctgcaatcaacggtggtaattcatcgccttctgtctgctcattttgttgattttcaaaacggcgcatcatcagttgatattcagcaattaaatctagtgccgcccgattattttcaatatgacgcagcgattcaaccgtcccaactgccacacgatacatatagattttggcatcaaattcactcagcagttgatcatcaactggtacgagtcctgtctcatcatttgtatcttcgtgggcagtccctcgtaattcaatcggcgttctcaccttggttaatattgggataaagacaatcgccatcaccaagctaacgataatgacgccggctgcaataaatagcattaaaccgcgttctggaaatggtgacccatcagcaagcacagtcggtacagaaagcaccccggccatcgtaatggctcctcgcacacctgaaagccctgaaaggactgaaattttaaggttatcttttaattgcttcggattcgatttgttagtgtacaacaagtaacttaatgtccaacaggttcgaattagaattagaattccccaaaccgctaataccaagagaatttcttctcccgtattaatcagtggactatgcaccgtccccctcatcgcaactggtaattcaatccctaagattaaaaagacaaggccattcaataaataaacaccaatcgaccaagtttgttccgtcactaattttagttctggtaaataatccaagtaaatattgcgacttgcgtgactaataatcccagccacaaccacggcaatcacacctgaggcatggagtaaatcttcaaccactagataaatcacaaagggggtaatcaactgcaagacggtgtggaaaacaacatcttcaatcccctgttgcaacataaacagtcgaataaaatgaattgcatacatcaacaacatcccagcaattgcgccaacaatactgatgtataagaaatcaccggcagcttgttgaatcgagaagtagccagttaccgcagcggcaatcccgtatttaaaactaatcaagccactggcatcgttaattaaactttcgccactaaccaaatgtaaaacccgtggcggcaagtcggcctgttctgaaatcgactggaccgccatcggatccgttggtgataaaatagcggctaatgcaaaactcgccgccaatggcaacttaggcactagcaaatgaatcgctaagcccccaatcaatgtggtgacaaatactaagaaaatcgcgtttccaataatcggtcctcgcagtgcccataattcccgtttaggaaaccggcggccgtcgttaaacaacaacggcgcgacaaacactaacataaaccaatctgtttttaatggaatctcaactgaaaaaagtagtgccaccagcaagcccaacccaatttcaatcaggctgaccggtagtcgtggtacatagtgaccgatgatattagcgacaatcaacagcatcactaacaaaataacagcttcaatgatagccatctattctgattttttaccgataattcgcacttctggttcaaggcgaacttcgaatttgtgccaaattgtttcttgaatatacgcaattaacgttaaataatcagtggcagttgcgccgccacgattaacaataaaaccagcgtgtttttctgaaacttgtgcgccaccaatttgatgtccttgaaggcctgctttttgaattaaaggccccacaaaatggcccactggtcgtttgaagacactcccacatgaagggtattccaatggttgtttagcagcgcgtaatgcgtttaactcatccattttctcgcggatggttggtgcaacacctttagccatttcaaaacgggctgacaatacaatactcccattttcttggattaaactatgccggtagctgaaatttaattcggcgttcgttaacgtttcaatttcattatcctgcgttaaaatttcggcagatgttaagacatcactaatctcaccaccgtatgccccagcattcatgaatactgcgcccccgacgcttccaggaatcccagccgcaaattctaaccccgtcaaactaccactataggcagcctcagaggtttggataatcccagctccggcttgtgcaaccacagttgtgccctgcacatcgatttgatccatggcggtcaagataatcactaagccactaatcccatcatcacggacgattaaattactagcattcccgatcacagtaattggtaattgattctgcttagcggctactaataattggcgcacttcaggaactgacgttggtaaggctaataaatcagccggaccaccggttttggtgaaggtatatttacttaaaggttcattggttttaacattaattgtttgatttgcttctaaaaatgcgttgatttgacttaacacatgaaatttatctcttggaatgttaatggcttacgagccgttttaaaaaaggattttatgactacctttgaacaattagatgccgattttttctgtctacaagaaacaaaaatgcaagctggtcaagttgaacttgatctacctggctaccatcaatactttaattatgccgagaaaaaaggttattctggtacggctattttcacgaaacacgaaccactcaatgtcacttacggtattcaacaacctgaacatgaccatgagggccgtgtaattacattagaataccctcaatttttcttgatcacttgctacacccctaattcgcaaaatcaattaaaacggttagattaccgcatgacttgggaaaacgcatttagagcttacgtgcaacaactaggtacgcaaaagccagttattttctgcggtgatttaaacgtggctcatgaagcaattgatttgaaaaacgatcgaaccaaccacaagagtgctggtttttccgatgaagaacgggcccaaatgacgacccttcttcaatcaggattcacagacactttccgttatttctatcccgaccaaaccgatatttattcatggtggagttatcgattccatgcgcgtgataacaatgccggttggcggattgactatttcatcacttctgacgagctccaaccaaaattaatggatgccaaaatccatacggaaatctatggttcagatcattgtcccgtagaacttgacacacaagatttattcgcttaggtgaatttcgttgcaatggattttgaaaccgccaatggtcaacgcgacagtgcttgttcaattgcactagtcgttgttcgtaacgaccaaattgtcgatcaattttacacccttattaaacccgaaacttattttagtagccgtaatagccagattcacggtatttatgaagaagatgtggcccaagcccctaagtttgatcaagtttggccacacatcgcaccttttttcacaccgcaaaaattagttgtggcgcacaatgcgacctttgatatcggtgtccttcgtagcacactccaacactacgacatcccagaaccccactatttggccctcgacaccttaacaactagtcgccggctttatccccaatttgaaaaccataagttaaatacgttatgtaccaacttagaaattccactcgaaaatcaccacaatgcgctagctgacagtatcgcatgcgccaaaattctgattaaagaagcacaagagtttggcacagacccactaaaacaggtcacaaaaataatcggctagttattttttgctgattccccggcgatttccaaaactaagaatgaaaactgtactgatcaccaacaagcccccgatgacttcccaatgattgaaactcgtttttaaaaataacactgtcccaattgtcgcagctaacggttcaaaagtattcaataaaccggctgttgtgggggtaatgtaattcaagctccctaaaaagcaaaggttagccaaagctgtcccaaaaatggcaataaataacacactgatgattgtgggcatgttcattggtggtgcatccacccaaaatggatgaatcacattaaataacacgcctccaattagcattgcccaggccacaatcaccaacgtatcatacttctgaaataatttacctgggattaacgtatttaatgcacctgagaaaccaagacacaagcccaagcctaatgctgcgcatgaaatcaataactgagtgagttgccccttagtgaccaataaccaagtccccaataaagcgacaatcacagctattaattcggttcggctaggtgtcttatgatagatcacaagactgataatgataatcatgacggtccctaattgttgtaaaatcgtcgtagtcggtgcgttgctagcttgaatcgttaaaaaataagcgtactggacagccgataatcctaaaatagcaaaagccaatagtcgcccagcatctcgcggttgccgccaaactgctgtgacagttttcggttgcttactgaatgcataacctaataagaagagccctgataaccccattttgacgcccatcaaccactctggtgcaattggtgtatctgtaaatagccattgtgatactggcccctgaataccccaaaaaattgagcctaaaattgctaaatagatcccttttctccgttgttgtatcacctactctatattaatcaagcgcaccatttgcaatactggcagcatgccaactgccggatcataatagcccgcttctagtttggcctcaatttgaaaaccaaattgctgataaagttgaatcgcaccttggttacgtgcttgaactgttaatacgattcggcgcggttgtccactagcgctggttgcttgtaatagtgcgtctaacaattgtgtgccaattttttgtcgccagtatgtttttaaaacggcaacacttatttcgccaatgtgttgcaagcctggttcgggttcactcacaagccgagcagccccgacaatcttagccccatcaactgccacccataaagcatcagttgaactatcaagcacggctcgtaacgtcagttcgcaaaacgcctcagacatcgccaagttttccgctgcaatcggtaaaaatggcgtttcctgtaccacttggtttaaaaaacataaataagcccgtgcatccgttacctgcacaggccgaattactaaagatttagttgtcaattagttgtcaaaactagcctcgaccaaggctgtatagcgtgtgccatgcggttcaaaaacaagtgtccgcatttgatcgtcgtcatcatttttattgaaatgaatcgtcaagtagtcacttggtaattcatcagcaataaattgactccattcaatgactgaaacaccatccccatcaaaatattcctctaaaccaagatcactggcgccggtttcttctaaccgataaacatccatatgataaagtggaatccggccatctgggtattctcgaatcaaagtaaacgtgggacttttgatataccgtttaatatccaaaccttccgctaatcccttagtgaaagttgttttaccggcacccaaatcaccatcgagtagtaaaacatcgcctgcttgcaattggcggcctaattttttagcaatcgtaatcgtttcttctggttgcgttgtttgaaattctaacatctagttttgtaatgcttgggcagctgtgatgatggctaacttgtagacatcttcttcattgctcccgcgtgataaatctgagattggtttgttcaagccttgtaggattggaccgattgcttcgaagttaccgaaacgttgggcaatcttgtagccaatgttccctgattgcaattctgggaatacgaagacgttggcttgaccagcgacttttgaatctggtgctttttggttagcaactactgggacataagcggcatcgaattgtaattcaccgtcgatgtctaagtcaggtgctaattctttggcaatcttcgttgcttcttggacttttgtcacttcttcaccacgggcagaacccattgttgagaagctcaaaagtgccactttaggatcaatatcaaataattcagcagtgcgtgctgaagccactgcaatttctgctaattcttgtgcatttggattgatgttgatcgcacagtctgagaataaataacgttcattgtcgcgaccgcgttgcatgatgaaggccccacttgtccgttggatgccgggttttgttttaataatttgaagagctggacggactgtatcaccggttgagtgaacagcacctgagaccatcccgtcggccaaatcaagataaaccatcattgtgccaaagtaattaggatcttgtaaaatagtttgggcttgttccgccgttgctttacctttacgacgttcaacaaaagctgctaccattgtgtcaaaatctgcttgaggatacgctttaggatcaataattgtaatccctgtgaggttaaaccctttggcagatgcaatgctttgaatatcagctgcatccccgattaaaattggttttaaaattcgatcagcatttaaacgggctgctgcaccaataattctaggttctgttccttcaggaaaaacaatcttaaaatcatgactcgtaatttttgctttcaaactttcaaataaatccaattacttttgttcagaaacgtcttgtggtaattgccaattaatgggcgtcattgcccactgttttaactgctgatttgtttgtgaaaacggtttggaaccaaagaagccatgataggctgctagcggacttggatgaacagccgttaacaccgcattttgactttcatcgattaaggcccgttttgctttagccgcattgccccataaaatgaagaccacgtgcccgcgctgtgacaaggctgcaatcgccgcatcagttagttgttcccaaccttgctggcgatgggaattagcctcaccggctcgcacagtcaagacagtattcaataggaacaccccttgatctgcccaggccttcaaatagccatgattaacgggattaaaaccgacatccgtttgtagttccttatagatattctttaatgatggtggcactttaacccctggcaatactgagaaactacagccgtgcgcttgatgtggaccgtgataaggatcttgacccagtatcacaactttaacttgttcgaatggcgtccactcgaaagcttgaaaaatatggtgcatttccggatagaccgtagtcgtcgcatattcttgcttcaaaaattgatgtaactgaccataataaggtttggcaaactctggttctaagacggtttgccaatcattatgaataattgttttcatttgatttcacttatcgcatctgacatggacggtacccttttaaatgataaaatgcaggtttctgacggtaacatcaatgccatcaaagcggctcaagacgctggtattgaattcatcgtcgctaccgggcgcagtcgcaacgaagcacttccgctaatggctgaaggtggtatcaaaccagccctaattaccatgaatggcgcccaagtcttcgatcaattgggcaacgaagtcatcaacattccaattgaacccgctactgtcgtggcagttacggatgaattacgcgctagtggttactattttgaattgatgaccactgccgggaactattctgacagccaggtcaatcgcattcaaaatgtggccgatctattagtcgacctcaatcctaataccagttataaaattgccgttgccctagctgcagcgcgcctagaattaatgaatatcaactatgtcgatgatcattatgccggcattattgctgatccaaccattaaaattgttaaaattattgctttcagtacgaaaggccttgcggatttagaacccgtgaaggttttctgtgaagaacgcggcgatttaattgtcacctcctcttcaagcaataacatcgaaatcaaccacatcaacgcgcaaaaagggattgcacttgcagcctatgccaaagaaaaaggaattccaatgtctgaaacaatggcgattggtgataacctcaatgattattccatgattgaagcagcgggcatcggcgtggcaatggctaatgcagtgcccacgattaccgacttagccaattaccataccgctaaaaacacacaagacggcgttgctcaagccatttatcacgccattgatcttaaccaagcagccgaaaagaagtgaatgcctgatttatacattaagcatcaagcaagtgccttaaaaggggtctcaacgattatggatgaccaccaacggcccttattcctcttagtcggcagtcgcggcttacgccaagatggcttttcactctaccaactttcgggtgaattactcggtgaaatcaaacagaaatcactcgggttttcacccagttttgaactatttcaaaacggccaatcaatcggcagcctccagaagatttggggtgtttggcatgaattcgtctatgttaaaaatctcaactggctaatcatgggcgacctaattcagaatcaataccgcattatctaccatacccaaaccatcatgcaaactaatatcatcctgacaagtgccgggcctacttttaaattagcgattgcggaagatgcagatcaggtctcttgcatcttgattgcagccgttttaaaccattgggtgtatacacaaccgaaggctttcattcataaattagcacctaacacgcttcgctttagttaaatgccaactggcgtcattattaattcattatccgtcttattcggcggtattatcggtggtttattgggtgataaactatccgctagattcaaaacagagatcactttaatcttcggcgtttgttcaatgggaatgggcatcaacgcaattgttgtcatgcgaaatatgccggccgttatcctcgcaattgtcttaggaactggcattggactagccgttcatttcggtcactggattgatcgtggcgccatcttaatggaaaagcccatttcaaaactatttccagttcgtaaaacaactttgacagatgctgaatttatttcagccctcgtaaccgtcatcgttttattttgtgcaggcggcaccggtatctatggtacgctcgatgccggtatgactggtaatagcaccatccttatttccaaatcagtgctcgatttcttcaccgcagcgatttttgcttgcaacttagggtatgtcgtttcagccattgccattccgcaatttatcatcttctatattattttcttactcgctaaattaattttcccattaaccacacctaccatgattgccgatttcaaagcctgtggtggctttttaatgctcgcaactggtttccgaatggttaaaattaaagagtttcccattgcggatatgatcccggcaatgatcctcgtcatgccacttagctggctatggaccacggtgatcatgccgctattatcgtaatcaatacgataccggatactcataccgacttttaatcaattcgtgtgcttcatttgactcatataaattgcgagactgctgattctcaaattcaatttcataaagactacccactggaaaattccgaattatttctatgggtaaatattgcttcatcattggttcagatagtccctcatcgtcggattcaatcaaattagcgagcatccccgttgacatttcttttactggaatatattttttaatataaaaataggttctactattcgtctgtcgacttagccactggattctttctttgaatggtctagtctttagccacgtataatgctctaaaaaacgacgccaaaaagcgagttcagttgagtaaaagcgaatctccccgccattggtcaaatcatttatttctgttctatcggcacttccttctaataaaccactcagcatttcagaaactggttgattgaattctgaatattcgttggactgctccaaaagcattgtttcctgttttgataagccaacaatattaggagttgtcgaagtgcccctaaatgaatattcactatctcctgacattgatttcatatatagtcttgttaaagcctttttacgttgcgctttcgtcaatttaacggttatatcaaacccgccgtcttcatcagcaaacatccaatcgtgtgttatcttgggtgctatccccagcactgttcgatagtaacgattacctgccgtaatatatgatccgtattctgcttttggcacatgacacatcgttaaaataagtacaccaaataacaacatgatagttaggcaaccaattgaacagccccttgcccagcgcatcgttttttgcttcatttaaatagctttgaccatatgttcataacggtgatcaccaatcattagctcaccttttttaacaaaacccatgcgctcgtataatttcttagcaccggaattttgtaaatcgacgctgaggctgatcatcttctcgccacgttgtttcaagtaatcaggcaaagccttcaaaagagcggtcccaacaccacgtccttgtgcgtgttcagccacagctagtgtgtctaaataccattcacctggttgggcttctttatccgtgaaaaagcgcgtttcttcaggtaaaccgatttgtgggaaaagtggtgctaatacatcatcgatgtgggcttccttttcttctgggaaaccaacgacaatccctaatatttcaccgtcttcttcataaaccagcgtattagcatagctataccggtattctggcatttcaaatgcttgttttaagatcttaaatagattttcgagcggtatctcctgaaaaagtggcatctccatttcttcaaaaacaatattaataatgggtaagacactttgtgcatcttcaattgttgcttgacgaatcatctaatctaaatctgcacgataatccgccattttcttagcgaataactctccgttagtcggcggcgtataggtcaacgcattggcgccagcctcaatcgtacttagaatggcctcttcatcatgcccacctgtcgcgatgattggaatctgagggtatttttggcgaatcgctttaataatcgctggtgtcttcgccgcaccacttacattgagaattgaaaccccggcttcaatctgggccgcatagttctgacgttcggagacaaccgtaccgacgattggcacatccactaccttattaatcattttaatggtctcaacagaagttggcgcattgaccaccacacccattgaaccagccgcttccgccaataagcccatgtatgcggagcgactaccagatgttaatccgccgccaatcccgtttaaaactggaatggtcgcgacattactgatggcattcattaccgcgggatgtggtgtaaaaggataaacagctaatacagcatccgcattggtattattgacgattgctacgtcagtcgtgaagatcaacgttttaattttttggcctaaaatcttaataccaccaacttggcgcgcaattgcgggtggtccaacaacactcgttttaagtggtgtataaatttccggtataaatttttctgtcattcagtcctcctcatttaaaagttgttgtaatcgctgcgccaatgccgttagttgagacgtattgagacgcgcaaaattaattcgaaaagcagcctggtgcgcaccaaataatgtgcctggtgctagtgccacatgcgacgcaacaaatggtgctagtgcatacggtttaactgctcgtgtcccccaaatataaaaaccaccttgggccacactgaactgccagtcaggtaatgcacgcgccaaaaactgttgcgtctgctgtgcccttgtctgtagttgttgacgcaacgtgactaattgcgtttgaaaatgcggctcctgaattgccaaggccgccatcacttgcgacataatactcggaaccaaatccatttcccgctgaacacgcaccaattggtcaatcacttgcggcgttgcggcgacccacccaattcgggtgctggcacccatgatcttggacaaagaactcatataaatcacattttcaggatcaagttgcttgagcgttggcaaggctggcgtcgtttcaaagcgtaaccaaccaaaaacatcatcttcaacaatcggcacttgataagtctggcaaagccgaataaccgcctgtcgtcgttctaagctcatgacttgacccgtcggattttgataatttggattgagaatgactaatttaatgcgatgctttacaatcagctgctccagcgcagccaattgaatgccttctgcatcgagcggtgcaccaaacgagcgaatccccgttgcctcaaataaggttgcttcatggaaaaacgatggcgattcaaccgccactgcatcccccggtaccaataaaccctgtaatactagaaagagcgattgttgcgcacccgctgtcagtaaaagttgcccttcagggagcaccaatttttgattctcctgattcaagcggttaatcgccgttaacaatggggcataaccaagtcgtgtttctgcttcttgagcttggttaaaatcttgccacgttaacggtggaaattggaattgcggcatcaaatcagctggtaagtcgctcgaataaacatcgattaaatcggcgggttgctgtgcaattaattgttgcagtgctagacgcttagcctgcccaacttgaaaaggttgcgacgttaaatacgtatgccaattaacgcgccgctgtgcttgttgttcaccagcctgttgactgatgaaagtcccactaccaacacgccgcaccaatataccatctgttgtcagctcatcaaacgctcgcgtcacagtcgagcgattcactgttaattgtgttgctaaccaccgttctgccggtaattgttcgcctggcgataataacccctgctctaacagattaatcaccatttttttaatcgctaaatattttggtttctgtgctggtaaataacgtgcccaatctatcaaatgtcaaacattctaactattgctggttctgatacattgggtggcggtggcttgcaggcggatttgaaaaccttcgaagcctttggtcacttcggtgtcagtgctgtgacctgcctcgcaacggtcatgccggatcaaacttttcaaattcagaatatcgaaaccgaaacggtattagcccagattgaagccattttgcattacgtgccactaacgactatcaaaattggcttaatcaacgatgccacgacacttgaaaaaattggtcatcttttacaaaaacaaccgcatttgcaaatcatcacggatccggtcttggccttcaaagaaaccactgataagctgcaacaacactatctagatagtctgaaggaattcttattgccgcaatccctagtcgtaacccctaatctagttgaagcccaaatactaagtggcttgccccagattcagacacgggcagaactggaacaagccgcaaccattatccaatctctcgggccacaacacgtcgttatcaagggtggacaacgtttccctggtgatgacgccatcgatttgttgcatagtggcacaactaaccactacctcagcgcaccacgcttaactagcgcaacccgcaacggtgctggttgtaccctatcagccgccattacggctgaaattgcaagcggtcatgccgtttatcccgcagttaaagcggctaaacaattcgtctatcacgggattcaaaatgggattcaactgcgccatggcttcggtaatgtgcgccaaggaggctcatatgaattttaaatgaattttaagcagcgtcaaatacccgttattgcgattctaacggccctcaccgtttctttatctatgttattcatcattcccgtcccagcaactaaaggttttgtcacgctctgtgaagtgggtatttacaccacggcaattattttaaagaatccgggtggtttagcagttggtgcgttgagcggtttactaatcgatttattgtcaggttatccggaatggtgcttgttctcccttttaattcatgggacccaaggctttgttgtggcgtacctcacccgcaatgatgaacggcccagacgcttattcatgccactgctatgcgggagcgtcatcatggtcgttggttattgtttagccacgagctggcttttcggttgggccgcaggaatcgcctctatttttagtaatatcgtccaaaatggctttggtattttagtcacagttcccctggtcaaacaactttaccgggttcgtccccaactttttagtgaatagatgtcaattaatctcaatcaaattaaacaggatttaacccaaattaccaacgacgtcttaacagccgccaatctaagccgcggcgatatcttcgtgctcggttgttcaacgagtgaagtcgttggcggtcacattggcaaagcctctagccgcgaagtcggcgcaacgattatcgaaacccttttagaaattctcaagccactcgatatccaattagctgttcaaggttgtgaacacatcaatcgtagtttagtaatggaacgttccgtcgctgaggcacacgattttgaaattgtctcagtcgttcctgcaatgcacgctggtggggcttgttccgtcgctgcttttgaacaatatagcgaccccgttgaggtggaacatatcgtcgcccatgccggccttgatattggggatacggccattggcatgcacgtgaagtttgtgcaagttcccgttcgtcctagtctcgatacattaggtgctgcacacgtgacagcactccgatcacgaccaaaatacgtcggtggcccacgcgctacttatgacatttaaatgaaagttgttcaggattatctgacttcctccataggatacagattaattgctaggaaatacggtattaaaagttcttcatctgttcttttttggattcgacgttatgagacctttggtctaaaggggctcgatgtcctatcacctgataaaatatttgatggctcatttaagatgaatgttttaaaatggatgaaaacgaataaggcttcttatccgaaaaccgcacttcattttaatatctcaaacgtcgggaccatctggcaatggcaacatatttgggagactgagggtgctgatgccttatatcgttccaaaggacggcaaacaattatgacagctgataaacaatcgaaaaaacggcagcaaacagaactagaacgtctgagagaagaaaatgaattactacaaatcgagaatgaatacctaaaaaaattaagagccttagttcaggaagaagaagacaacaagcgcaagtcatccaagagctaaatggctaaaagtacgtatgaatacattattagccatgaaccgaacggttcatctgaccaatctgttaaacaagccatccaaacaatcaagaagaatcatccagcgtacggttatcgtcgtgtaactggtgaattacatcgtatgaatatcttagtaaatcataaaaaagtgcttgtcttaatgcgagaactacaattactatcaactgcatttaacaaacgtactcgtaagtataattcatatagaggtaatgttgggaccgttgctaagaacttaatccaccgtcgtttcttcactgatcgtccctatcaaaaactagtgacagatgttactgaagttcgctggggaaccaagacaattgacgaacgtgcctatttcacatgtatttatgatttattctcaggtgaaattcttagccatcaagttagcagacaccctactgttgaatttacaacaactgttttaaatcgagcagttaagaaaatccctaagaatttaaaataccggacaacagtccactcagatcaagggtttcaataccagcatcaagattggactaatatcttgaaagaacatcgcatttttcaaagtatgtctcgaaaagcaacatgtttagataatgcatcaatggagagctttttccatattatgaaagccgaagctttctaccaaaaagaaaccgatacttatgaaacgctagtttcacaaatatcggtttggattgatgattataatttttcaagaattaaaacaaaactgggttgtaaaagtccggttgaataccgaatttttacaacccagaaagctgcttaattattctactgtaacactttttgctaggtttcttggttggtcaacgtcgtagcctctttgaagacttgcataataagcaatcagttgtcctgggatgatccctaataatggtgctagtaatggattaacatttggtaagatgacttggtcgccagcttgtgcgtgatcttcgctgacaatcgttaacgtcttagcgccacgtgcgcgaacttcttgcaagttgccccgcgtatgatcgatcgtcttagcatctgttaagaaggccatcactggtgtgccatcttcaatcaaggcaatcgtcccatgtttcaattcaccggcagcaaagccttctgcttgaatatatgaaatttccttcaacttcaaggcagcttctaaactcaaagcataatcttcgccacggccgatgtaaaaggcattgcgcgttgtcttcaagtacatcgttgtgaaatcttcaatcgcttgtttttcactcaataaagtttccatgccagttgcgactaaagccaactcatgattaacgtcgaaatcttgggcggccttgatagcggtatggcgaccaagtgctactgctaagaataattcaactgcaatttgagctgtataagccttcgttgaagcgaccgcaatttcaggacccgcatgaagcaacaatgtataattggcttctcgtgaaagggttgacccttggctattagtaattgttaaacttggataacctaatctattcgtttgcaccaatacttgacgactatcagctgtttcaccactttgtgttaggaaaatgaagaatggtttcttcgatagaattggcatgtgatagccaaattcactcgccacatgaacttccactggtttttccgctaatttttcaaataatgattgaccaattaaaccggcgtggtaacttgtcccggctgccacaatgtaaatccggtctgcgtcatcaattgccttaagaattgctggatcgattttcatttgaccagcgtcatccacatattcggttaacaaacggcgcattactgcgggttgttcgtcaacttcttttaacatgtaatgggggtaagtccccttgccggctgcactggcatccatgtcaacatggtagctatcacggtgaatgaaagtcccgtctaaatcttcaatttcaaccttgtcctttttaagagtgaccatttcgcggtcgtgaatttcaataaagtctttggtttcgtttaacatcgctaaagcatctgaacaaacaacgttgaaatcagcaccgacaccaattaataatggtgacttattcttagccacgtataacgtctccggatcgttccgatcaatcatgacaaaggcgtatgagccttcaatcaaggttagggccttgcggaaagcttccttagctgatagttgttctgtcttagctaaataagcgattaattgaactgccacttcagtatctgtttcacttgcaaagttgacttggcttaaataagttgcacgtaattcagcgtagtttgttaaaacgccgttgtggaccaagtaaaaacggccatcttctgaaacgtgtgggtgagcattggcttgacttgcaacaccatgcgttgcccaacgtgtatgaccaacaccaattgtaccctgtacttcaggaccaactgcggcttttaaaacactaattttacctggttctttaaccaaataatcgcgaccactttgactattaacataaatcccagctgaatcataaccccgataagctaatttttctaaaccatttaataaaatttcagtcgtatcttctttaccaatcacaccgacaattccacacatatgaaaaaagctattctaatgcttcgcctcatttcgctaatcgggttactagtcgggttgggtttcatcttggttacccctcagaccgtcgccttacatatcaccgctgataacgtcgttgattcatctggtagtcgcttcatgttgctcctcgaaccactcttattgataatcgtcaatgaagtcagtatcctcagcatcaaacgctatcgccgcaacttctcgttaaccgaggcgccgatgattcttgttaaagagtggtattacatctccgctgcgattgtcttgttgattacttttagttttttgatgtatcaacaaatcacttggcattaattactttcttaagtagaaataaccaaattgcgcaacaaaaataatagttaagacggttagaagccaccaccaattaatatctaaagggagaacctttaaaaaaaccaacccaaaatatataattcctaaaataattacctctgttgcaaaattcccaatagccttatacaacgctaatttcatttattcaccaatttcagattgaacgactgcggcaatttggtccgcatattggttaaccttttcttcagtagcggcttcacacatgacacgtaatagtggttctgtcccactaggacgaaccaagacgcggccatcaccgttcatttctttttcaacagtatcaatagcggcttggatcttatcatttgttaaccaagcatccttgtctttaactgttaagttaactaatttttgtgggtaagtttgaactggggctgccaattctgataacttcttaccggtttgtttcatgacattcattaattgaatcccagttaacatcccgtcaccagtgttatggtaatcaaaaataataatatggccagattgttcgccacctaagttaaagcctttttcgcgcatttcttcaacgacgtggcgatcaccaacgtctgtttgggcagatttcattccattagcttcaattgctttatacaagccaatgttactcatcactgttgtgacaattgtatcttgtttcaaacgacctttttcagaaagatagtgacccaaaataaacatgatcttgtcgccatcaataatgttccctaattcatcgactgcgatacaacgatcgccatcaccatcaaaagctaagcccatatcagcgcctgattccaaaacctttttaacaaggttttcaggatgagttgaacccacaccatcattgatatttaaaccgttaggatgagtagcagttgttgtgaaatcagtttctaaatcagcaaagacccggctaatcaaaccacttgttgagccgttagcgccatcaacagccacttttaagccttctaaatcatcaggaattgtatgttccaagaattgtgtatatttcaaagcaccttctggatattcttcaacagtcccaaggccttcaccttctggacgtggtaatgtatcttctggtgcatctaaaatagcttcaatttcttcttcagtggcatctggtaatttataaccatcagctccgaagaatttaatcccattataaatagcggggttatgtgatgcagaaatcatgatcccggcacttgcttcttgaaccttaattaaataagcaaccgctggcgttgtgatgacgcctaatgataggacttcaatcccgactgacaataagccagaaattaaagattgttccaacatttgtcctgaaatccgtgtatcgcgagcaactaacactttaggccgttggtttttatcagcatgttttgttaaaacgtagccgccagcgcgacctaatttaaatgccatttctgggcttaattctagattagcaacgccacgtacaccgtcagttccaaaatattttgtcatttatgattcgttcgtatttgctgtactgcttgagctgtcactactgctacttgactcactgctttgattattatcagtcgtctggctctcacttgtcgtactactgctactactttgcacttggctttgactcattgaagtcgtcgactccgatgaagactgcgtcgttgtttctgtacgactagtcgtcatcccagttggtgctgtcaccttaatattgaccttcacctgtttaggatgactgtcatagacgccacttggaagcgtcaaagtcaccgtacgcgtcgtatctttagtgatatccgccatatcaatcgttaccggtaagtctgttaaagtcgctaaggtttgtttcttcccatacacggttacttgttcagtttctgaactcaatgtgtattcgtagccactcctctcaccggttttttgtaaactcaacgggaccgtttttttattcatctgaacggcaattttaatattaaccgtttgaggtgaaattaaaacattcaccgtcttaccattacgatcaaccgcttgtagaagtgtttcttcattaatatcatttttggtccctttatcaggatcaattgtcgctaccactcgtgcaactgaattaacagctgccttggcaccactgacttgcacgacatcttgactaatcttaggattgccaatactatagccagtcgccaaattttcttccttgacgttaacttgtactgggaattccttagtcaatttatgttcaattttaaccttgattgtagctggttcaatcttcactttgatgtctttgttaatcccggtttgtgttaatttaaccgtatgcgtcccagcacctagcttcgttaaatcaccaatcacccgaaaattcaacgtattaacagcagatgtaatcaacgcattaggacctgataaggttactttaactttttgaggataaccggtaataaagtatttatcggtatccgcattaatttgcaacgggaccttcacggtttcactgcgtgtcgctaacatttgtgtgttgttattattaatttggcgcgtggtattaattttatcaatattaacgtagctaaaaaggagtaacgataagaaaagcgctaatatccggtacaaccaaggcccttctataaagtttttcatttatttatggcctccttttttgaagccgtcgacgaattcttgtaataggctcaccttatcttcttcttgcgtaattaagtgtgagtttaagtatttcaagtaatcttcccgcgttaagtcgcgcatcaattcgttattcttggttaacgtgacaccaccggtttcttcagaaacaacgatcgtcaacgcgtccgttacttcactaatcccgacagccgcacgatgccgcgtccccagttccttaggaattagattactttctgacagtggcaagtaagccgccgcaacggcaatcttatcctcgcgaataataacggccccatcatgcagtggcgtgttgggaataaagatattaatcaataattcccccgtcacatcagcatccaaatcaatcccggtttcaatataatcttctaaccccgtattcatctgaatggtaatcaatgccccaattcgccgcttggacatgtactgaatcgccttatctaaggctttaatcaagttattttctttttcaagcttaggattgttgccccgcatcaatagcgaaccgcgcccgatatgttccaaaccacgacgaatttctggttggaagatgacgattaacgcaatcacaatccaactgataaattgatccatgatgtacgaaacggttcttagaccaaggtaccaactgacaatcttgatgatggcaatgaccatgatgcctttgaaaagctgcacggctttcgtgccccgaatcaacatgattaatttataaataaaataccagaccacaatgatatccaaaatattggctaacatgcgccaggttaacaattgtgcccaatcaactgacatttaatgttgcatcttaaattctaggaataaatcgttgtatagaccaaccatctcaggtgataaatcactataaacttgtagtttattcagcactttttgacttgggtaataggctggattattccgggttgctgccggcaataacgctttagccggcatattcggtgttgaatagccaatgtattccgcattttgcgccgcattcttaggttctaacatgaagtttaaaaaggcataggctgctttagtatgtttagctgtctttggaatcacgaggttatcaaaccaaacgttactcccctcttctgggatcacatagtgcaagtgtttgttattggctaacatttcagccgcttcaccggaccaggtcacagcgacactcgcttcattttgaaccatgtacatcttaatttcatcggcaacaatcgccttaacattgggtgccatctgatcaagacgggctttagcggcttttaacgccactgggttggtactattaacggactgaccgttttcaatcaagcccaccgccatcatgtcccgcgcactatcgacgaccatgattttaccgcgatatttcgcttgccataaatcggaccaatgcgttaagggctgatcgactaattgatcattatagataatacctaatgttccccagaaataagggagtgagtatttattgcccgggtcaaatggttggttcaaataaggtttgccaatgttttgaaagccggttaagcgtgaatgatcgattggtttcaaaagattggccttccgcattttttcaatcatatattcactgggaactgccaaatcgtaagccgtgccaccttgtttaatcttagtgtacatcgcttcattactatcaaaggtttcaaccgaaacgtgatagccggtttgcttttcaaacttcttaattaatgatgggtcgatataatcgccccaattatagagggttaatgtattatttttcgtataaccttgcgatttttgtagctgaaccgtcccgaaccaaagggctgcacagacgacgaggattgctaacgttaatcgtcctaatttattcattcatttaactggcgcccccattttctgcttccgttttgctttatgcgcttgattgcgttgatttaacaagtaatagccacccactaacaatagtgagaagacaaacatcaaggctgatagcgcgttaatttctaaactaatcccttgtcgagctcgtgaataaatctcaacggacaacgtttcaaaaccgttgccggtaacgaagaaggtcaccgcaaagtcatcaagtgagtaggtaaaagccatgaaaaagccggcaaaaatgcctgaactaatatacggtaaaattaccttgctgagtacttgccaatcagtcgcacctaaatcacgcgccgcatcaactaatgcaggtcgcatttcgtttaatttaggcagaaccattaaaaccacaattggaattgagaaggcaatatgactcagtaagactgacccaaatcctagtccaaggcccaagaacgtgaagaaaatcaggaagctggccccaatgataacatcgggtgaaaccatcaaaatattattcaaagataaaataatatttcttaaccgccgttgcttggtggaataaatccccaacgcgccaaaggtcccaatgatcgtggcacatagtgatgataaaatcgcaattaatagtgtttctaagacaatctcaatcatccgtgtatctgcaaataaatcttggtaattttgccaagtgaacgatttaaagccgttcatattgtcgccgctactgaaagaatagaaaatcagataaaaaatcggtgcgtacaacaaaatgaagacgacaattaaccaaacatgttgccatttaatctcagcttgtttcattcatttcatcgtcaccttcttcttcgtcttcttttcaccggttaacatcatgataaggcccattgcgacaatcaagacaaccccgattgtcgaacccatgccccaattcatcgtcgttaggaaatgttcttcaatcgcggtccctaaagtaatcacccggttacccccgattaaacgcgttaacatgaatagtgataatgatgggatgaagatggcttggacacctgctttaacaccggccatcgtcaagggtaacacgacttttgaaaaggtctgccaattactggcccctaaatcgcgactcgcattcactaaagaaggatttaattcttccaaactattgaaaatcggtaaaatcataaatggaatttcaatataggtcgccaccaccaagaaactaaaattggtgaataaaatctgttgcggtccaatcccaaaccaccctaagaaatgattgatggcgccatcttgactgaaaatcccgataaaggcgtatgcttttaacaagagattaatccaagttggtaaaataatgagtaatagccacaattgcttatgcttggtttgatggagccaataagctgttggataactaattaataacgtaattaacgtaatcaaaaaagcataccacagtgaattaagcgtcatcttcaaataagtaccggattcaaaataagtgacataattttggagcgtcacatggttattaatatcaaagaaggattgataaacgattaaagcgaccggcgctagcacgaataacaaaagccacagcgcgtaaggtaaataataaattaattgtttttttcgcatttaatcctcctcttcataactttcaagacgcgcgtcaaaatcttcttcagattcgccaaaacgcataacatgaacgtcttctggttcgaagaacaagccaacttgttggccatctttagctgggttagtcgaatgaattaaccaccggttacgatcgtcatcataggcggtaatttcataataatcccctcggaataattgcgtatcaacggtcacgactaactgtccttggttgacggctacgatatccaaatcttctggacgtaacacaatttcaacggcttcattaggtttcatccctgcatcagcgcattcaaaaactttaccgacaatttctacttgataatcagcaaccattttcccgggcaatatattactttccccaatgaaatctgcgacaaagtgattaattggttcatcgtaaatatcaacgggggtcccgctttgaaggacattcccctcgttcataacaaagatttcatcactcattgcaagtgcttcttcttgatcatgcgtcacaaacaagaaggtaatccctaatcgttgttggagatcacgtaattcatattgcattgcttttcttaatttcatatctaacgctgataacggttcgtctaataggaggactttaggctcgttggctaaagcacgggcaattgccacccgttgttgttgcccacctgatagttcactaatttcacggtgttcatagccacccaaccgcacaagtttcagtgcttcaatcacctttttttcaacgtcttttttgttaactttacgtaaatttaacccaaaggcaacattatcgaaaacattcagatggggaaatagcgcataatcttgaaaaacagtattgacctgacgcttattagccggcaaatcattcatccgttttccttcaaataaaacatccccagaagaggcatttgtaaaaccagcaataattctcagaattgttgtcttaccacagcctgagggccccaataaggtataaaacttacctttttctagtgccatatcaattccctttaggatttgattatcgtcatacttcttgatgacgtttttgaattccaccattggttgctgcatatggtcgcttatcaagctttagttttaacgcacgacaacgaaactgttactgctcagtacgcaacaaaattgacacctgatttaccaaaagaaggcgtcttaatcaaagttgcctactcagatatcaattacaaagaccgcctcactatgaatgctaaaagtggcgttcttaaaaactatcccgcaacacccggcgttgattttgtcggcaccgtggtcaactcggacaatccgttcttcgaggctggtgaatgggtcttatgtacaggttatggtaccggtattagtatcgacggcggttatgcacaatacgtcaaagtccctagcgaatggctcttgaaatgtccaattgaactaacaccccaagaaataatgcaacttgggacggccgggttcaccgcggctatcgcccttactaaaattcttagacaaccttttacacgggatcacgatacgccactactaatcacaggtgcaactggtggcgttggcagctatgcactgacaatgttagcacaacttggtttcaccaacatcacagcgacgactcgcgatctcagccaagcagattacttaacccaactgggtgccaaacatgtcattgcaactgatgatctcttaaacgccccgctcaaaccattggcccatcaatcctatactggtgtaatcgacacacttggcggtgatgtcttagcacacattctcccttatatggcccaagatggcttagtcgcagcttgtggtaacgctgcaggctttaaacttgcaacaacggtcttccccttcattttacgaggggtaacactggttggcatcgattcggtcaattatccccgtaaggatcgcaaagaaatctggcagttgttagccactaacttcaaaccgcaaacctggccgttaattcgcaatatcgcattctcagaactcgtaactgaactaagcacgccaactaaacaagctggtcgcgtggtcgttaaaatcgatactgaacattaattatttatccattttttctttgacatcgtcgatgacttcatttgtcttttcagcgactttatccttagcttccgctaatttttctttggctttgcccatcatacccttggcattaccttttgcttctgtttctttgtcgcctgttactttaccggctgtttcttgaactttaccagtaacttgatctttcatgccatctaacttctctttatttgtcattcatttatcagtcaattgaccatcacgcatgatgtaaacttgatccgtataggctaaaacgcgttcatcgtgcgaaaccattacaatcgtctgacccgtttttttagtaatcgccgataactgctcagcaacctgaatggcacgtttgctatccaagctggcagtcggttcatcagcaaagattaacgctggttggccataaagcgcgcgggcaatcgcaacacgttggcgctgcccacctgataggctagccggatattgacggcgttggtccaatacccctagttccttcaaaaggtcgtctgccttattcggactcggcgttttccggagtcgatcaactaattcaaattgttcactgaccgttaaaaaggaaacgaggtttgaactttgcaagataaagccaaaatcgttaaaccgcaaagccgaccgttccttttccgttaagtgtccaatttcttgatccttaaaataaagctgcccatcactaggactttgcaagctgcccataatcgttagcaaggtggttttccctgaaccagagggccctgtcaaaccaataaattgccctttttcaatcgttaaatcgatttgcttaagggcggtcgtctgctgatcaccactaccaaatcgtttagtaatctgttctaagcgcattaaactcatttaagcccctccaatcgcatctagcggatcaatttttagaatccgccaaattgaaaatagtgcgccgaccaccgtcatcagcaatagcaccgctgaaaaggcaccgattaataaactattattcgcatacggcacactgactggtaataccaaggttgttagcaagttgccaatgaaaccagcacccacgccaattaagcctaggaagagtgattgccacatcaaactggccactaattgaccacctgatatcccttgggttcgcatgacaccataaaccgtcgttttttcaatggtgataatatacataaaaatccccacaatgaaggcaacaatgattaataaagcaccaatcatcagcgcgaaggttttcacttgtggcccatagcccggaatattatcgattaactgtttaatcgttagattggttaattggtcgtcctttttaatagaggcgccgtctcttaaaacgacggcattaatctgattgctagccgctgggccatagcgcatctgacgaaaagcctttaagctcaaatacgtgaccggttgcgtgttataccggtgatcgtttgttaacccaactaccttatatttttcagaacgcccgtttaatttaatctcctgattgagcttaatcccttggagactatcatcgacagccacttcgcgggtcgcttttggtaagcggcccttcgttaatgtcggttttagaaaagcatcgaaatcaatgccaaaaacactcgtattttgtttttcgatttgcgaaccactaacaacccccatcatctggcctaaataggcgcgatcttgttggtcccctttaatcgttggcagtgatcccgtttgtaactcggaagccgccaaatttttattcgcatactgactaatcacgattcgattggcgtcccaatgatcaattgctgaccggttattgttggccaacccatacgccaatcccgttaaaaaataaattaaataggcaatcaaaaaaagcgtaaaaataattaatgaataccgcaatttagcatgcttcatttccttaattgctagatacaatgtcctcattcaatgtttggggaaagcatattttggttcgtctaattgcgcatcataatcaattgctaggtcatagtcagcaaaaaaccaagcatccgaatcactggcgaaataagtaatcccgtctttttcaacttggccaatcggttgactgacttcagcccgttccatccctaatgaaaagccgtcatgaacagccgtttgaccgtaaaccttaccgaaaaagcgcactgcttctcctggttttaaagcgagttcctcttgaaaccagtgacttgctgcatctgtaactgtaatttgcatttaatccgctaattggtgcttgatggcataaattgcggcctgcgtccgatcgtcgacttgtaacttcgctaaaatattggaaacatgcgtcttaaccgttttaagtgtaatgaataattcatccgcaatttcttgattactgcgacccttggcaatcaaacctaggacttctcgttcacggttcgttaaatcttcgtataactttgtttctgcctgatgcgtcatacgattcatcatcttattagtgacttcaggttctaaaactgattgccccgcagttgtcttccgaatcgtgttggcaatctcttcggccgtcgacgtttttaatatgtaacttgctgcaccagcttcgattgctgggtagactttttcatcatcaataaagctggttagaataataatcttggcttgaggccaagcctttagaatcgtcttagtggcttcaatcccatccatttcaggcatgacgagatccattaaaatcgcatctggccgtagtgccaatgccttttcgacaccttcacgaccattaaccgcttgatcgaccacttctaaatcgtcttgcacccctaaataagttgaaatccccaatcgaaccatctcgtggtcatctacaatcaatacttttatcacttaatttcgctccttcaaaagtggtactctaatttcaacgcttgtgccttggttgggtaaactaataatcttagccgttccgccaaccgattgtgctcgctctgtaatgttatttaaaccgtaactgccagccttttgcgcaacctttggatcaaagccctggccatcgtccattactttcaataaaacggtctggccgatttttttcaaatagacttcaatttcttgggctttcgcatgccgcaaagtattggataataattcttggacgattctaaacagattatcctcaatcccacttggtagaataacattatcaatatcccaagtaatttccaccgcaattttagtcttcaattcattcaacaactgaataatcccatcgcgtaaactcttaccctccaacgtcactggccgtaaatgtaacaacaatgcccgcatctctgactgcgcatcattcaagacccgctcaaccgtcgttagcgattgtaacagctgcggattatccgcttgtttttgggccacttcgcttaatgccgacaacatcatcgtcgccgcaaataactgctgactaacagaatcatgcaactcgcgagctagacggtgccgctcttgggccaaaatttcttcttttgtctcacccgcaatcacaggtggccgatcactataactttgaatgtctcgttgtaagcgtatcattttttgccgtaattgttcaacagtttgttcgattgtcatcgaaaaattaccattatcggcatttatttgtttaaaaaccggtgattcgtactgtccggaaactaaatattgcaattggctctccgtatgtgagacctgttgacgtaaaacgagataaaaaatactcgtcacaaccgtcgctacaattaacgctgccacaataatataggcaattaacggtacatagaaaaagcgaaccgtcgctaggctcaataaccattgatcttgttgaatactatagaaatacgcaaaaaataacgccactgaaaacagaagcgtcaacaatccggtactaataaacacaaaactgcgcgcgagtttactcattcatactagaatcacctcaagatcgccaatcacgacattcgtgataattttcagatggcgactttcttcatcataattggtactatacaactgaagtgactcatttttcaagtgatattgttgttcatcaattgtgacagttcctaacatcgcagaatggtctaaataaatcccggtgcccactgggactaaaatccgcgttttaccaaaccctttacgaataacaatatgattatcatccttaggcaaaatcgtactgcccaaatcaataattgtatcaccggctaagacggcaaagttaatatcgtcccattcaaaaatattcgtcccaatcgtctgatgaccaaaccaattatgccgggtcacggtcgcttgttttggcttaggggcagtcgtattaatcggtatgaaattctttttgcgccatggtgcattttcaaataggttattcaaattacgattgttaaaatgacttgcatgactatggttgattgccataaaaacaactgcgacaatcaacatcaaccataatgaaaaattaatcaataatggcactgcgaccgccacactactcatcatcgttagaaacgtcgtccaaaagccccgcttattagccattcggcgtttattagcccagactaatccgagaatcccgataataatatagactaaataaggcggatacgtaataatctgccatataaaggtaccaaagatgattgcttctacgattaaaaaaatccgccagaaaaacggcatctatttaacttccgtaatggttacgtgcatgtcgccgcctggtgtttgaaccacgactttgtcaccgacgtgtttgccaactaatgcttgggcaattggtgagtcatttgaaatcttaccgttaaatggatcagattctgcagcgccaacaatttgataagtttcttcttcgccatcttcatcatctgtgaagctgacagttttaccaacagcgatttcatcaacagcaatattgtcaacatcaatcacttcagcaaaacgaagcatgttttcaacttcaacgatccgtgtttcaagtgagctttgttcatctttagcagattcgtattcagagttttctgataaatcaccgaaactacgtgcaatcttaatccgatcgattacttctggtcgtttaaccatttttaagttttcaagttctttagctaggttttctttaccttctgcagtcattgggaattttttttgtgccatttagtcattcatatttagaatagattgaatcttcgttaccaagagatcaatcgccactcggttgttaccaccttcgggcacgattaaatctgcataccgttttgttggttcaataaattcgtggaacataggtttaactgtcttgagatattgcatcacaatatcatcaaatgaacgtccccgactctccatatcacgactcatccgtcttaataaacgaatatcatcatccgtatcaacgtaaactttgatgtccatcaaatcacgtaaccgggcatccgctaataccaaaattccttccaagataatcacatcttgtggttccacatggacaacttcatctgtccggttgtggatcttataatcataaacaggttgttcaattgattgatgatttttcaacatggttgcttgttcgatcaataaatcagtatcaaacgcatctggatgatcatagttggtttcttggcgttcttcaaacgaaccatcttgatgtttataatacgcatcctgtggtaataacatcaccgaatggtttgcaaatttttgtgcgattgcctggctaacagtggttttgccactacctgaaccaccagttacgccgataattatgggtgcttttttttgactcgtcatctaatcttcgatcgagctcgttgtgtctgtatgttgctcgaaagtcttcgagtaataaaccttacccgtcttcaagttagccacaaagtagagataaccttgatcacgatcagctgggtttaagaccgccgttatagattgtaaacttggcgagttaaatggtcctggcccgtaacctgaatgaacatagaggttataaggtgagtcgactttagtatctttattatagagatgtgtcttatgcgtattcaatgcgtacataacagaaatatctgattgaattggcatatcaatatctaaacggttaaagaagacaccagcaatcttttgacgatcacttgcggttaccccttcacgttcaactaatgaggccaatgttaatgtttgttgaacagacaatttcttattcttcattgttgcataatatggttgtaagttttgatccgttgtcttcaccatttcggtaatcaattctttcaacgtgctgtctttatagacctcatacgttgctgggaagagataaccttctaagtgataacgaacgttcttcttagccatcgttgatgacaagagttgtgggtatttcttctcaagacttgccaagaatttcttatcttgaacctgcttcatgaaagcagccttcgagaatttggtttccttgccgactgcagttgcaatctgttcaagggtaaccccttctttgactaagaccttacccttcgaatcgcgaggacgggttggcgtcccttctttttgaaggttggcaataatcttatctaagctcattgattgtttcaaaacgtgataaccagcttggaaatcggtaaagttatgtgtcttcacgtaatagttaaagacagatgcattccgaatgagtcgcttatcttgtaagatagcggcaatttccttgttggttgatccgttaggaatctgaaccgtaatttcttgtttagcatttgtgttataaggtttcaacgatgattggacaaagcgataccccataaaaccaataatgatgactaaggctatcaggatactaataatccaatagacaattttattagctgcttttttttcagcccgtcgttcagcgtattgccgttcttcagccgttttttgatcaactggctccttttgatcagcattcttcaattaacggactttcgcttggaaagttgccactaagtgtgccacaactttttcaaaagccgcgttaacttcttcttctgttaaagtagcgtcttcattgagatatgtcaatgtataagccattgacttctcgccagcttcgatatgactgcccgcataaacgtcgaataatgatactgaaacaagataacggccgcctttttccttgattgcgttgaccaattcagcattcgtaactacttcaggcacttgtaaggcaatatcccgtgtcacttctgggaacttaggtgctggtttggcaataattgtttggcgttgtaattctaagattttagccaagtctaattcaaaaatataagtttcttttaaatgtgtggctttcgcaattttagggtggatttgaccaacaattccgatgaatgtttcaccgacataaatagcggcggtccgacccggatgcatctctggataagcatctgttgcttggtaggcaactgcttcttgcaagttatagctagccatcaaggtatcaacaacacccttgattgtgtaaaaatccactggtgctgccgcttcttgccatgatttcacttggcgattaccgctcattaaaccagcaacatattcgacttcattaggacgcgcttgatcagcgtgttgtaaaaagacacggccttgttcgtacaatgctaagtctgtttgtttccgtgcgacgttgtaggcagcatcatcgagtaaaccagtgacaagattcattcgtaaataagcatgatcttgcgtcattggccaatcaagaacagtcgctgtttgtttagcagctaatgcaaattgccctgctttttcttcggtcgtcaaggcataactaattgcttgggttaaaccagcaccttcaagcgtatgacgtgtccggcgtagcgccttttgttcggttgtcaaagcaccagttgtcatgtcgccagttggtaatgtacttggtaaattatcgtaaccgtataaacgagcgatttcttcaatcacgtctgcttggatttcaatatcccaacgacgggcaggaattgtcaccgtcaattggtcagcgttgttaaccacttcaaaaccaaaacgttcaagtaaatcaatcatcgtttgaacactcatgtcagtgcctaatacacggttgacccgtgctgaatcgatttgaattactttaggttgtggtgccaagtttgttgggctcactaccccagcagtcacttgaccagcgcctaattcagccatcatggctgcggcagcatctaaagccacttgaacatcagcaacattcacgcctttttcaaaacgtgatgaggcatctgaacgtaagttatggcgttgcgccgttttccgaacagccgttggggcaaaaatagcagcttcgataatcacatttttagtattagccgtaatttctgaattgaaaccacccataacaccagctaatgcgattggttggttgccatctgtgatgacaatatcttcattggttaaatcatgttctgcttcatcaagagtcgttaacttttcgcctgttttagctaaacggacttcaatttgtttgtgatcgccagttaaagtatcggcatcaaaagcgtgtaaaggttgaccgtacgttaacatcatgtagttcgtcacatcaacaaggttattgatggggcgaataccggcattccaaagccgtgtttgtaaccacaatggacttggttggactgtgacgttttgtaacatgcgcaagtgataactaggggctaattggtcatcagccacttgagcgctcacttgatcttttgtttgaacatcactttctgaaacagctacgtcttcaaaatgaggtgtcaatgattcaatagctgctacttcatgagccacaccgtgaatcccaagcgcatcggcccggttagctgttaaatcaagatcgataatgtaatcagtcatcccaagtgcttcgtaaacttcagtaccaggtgcaattgcttctggaaaaacgaagatgccatcaacatattctttaggtacaacgctatcggcaaaaccaatttcttgtaggccacaaatcatgcccattgaaacaacgcctcgcatcttgccttttttaatcttcacgttgtctgcaattcgtgagttaggtaaagcaacaatcacgtattgaccagcagccacattaggggcgccacagacaatttggaaaggttcttcttcaccaacgtcgacttcacaaacgtgtaggtgatctgaatcaggatgtggttcgcaacttaaaacgtgtcccacaacaatttttttcaagccagcactcatttgcgcaacgtctgcgacttcgatccctgttcgggtaattttttctgcaagtgcttctggcgcagttgttaaatctaaatagtcttttaaccagttataagatactttcatttaaccctcctgtgtgaattgatttaagaatcggacatcgtttaaatagaagttccgaatatcatccacaccatatttcaacattgcaaaccgatcgatcccaagtccaaaggcaaagccaccgtaaacttctggatcaacaccaccggcttttaaaacgtttggatgcgtcatcccagcacctaaaacttcaatccagccagtttgtttgcagacgttacagccttcaccattacaacggaaacatgagatatccacttcgacagaaggttccgtgaatgggaagtaacttggccggaaacgtagattacgatcttcaccaaaaatatggtgaattgtgtattctaaagtcccttttaagtcagccatcgtaatgttcttatcaatcacttgaccttccatttggtagaactgatgtgaatgtgttgcgtcatctgtatcacgacgataaacacgccctgggctaatcatcttgattgggccgttagcaaagtcatggctttcaaggtcacgtgcttcattaggtgacatatgcgtccgcatcaacgtatccttggtaatgtagaacgtatcttgcatatcacgagcagggtgatcagcaggcatgtttaacatttcaaagttatgcttttcatcttccacttcaaaaccggcaacaacttggtagcccatcccgatgaataaatcttctaaatcatcaatcacttgggttaacacgtgcggtgtaccctttttaacgggttgacctggtaatgtgacgtcgattgtttcgtgtgctaattgagcggcttcttttctagcttctaattctgctttacgggcttcaatcgcttgggccaaatcacccttgatctcgtttgcaaaagcccctactttaggccgttcttcgttacttaagtcccgcataccacgtaaaacttccgtaatagggcctttcttaccaagtacttctactcgaatctgattcaatgcatctaaatcaacaactttttggatatcttgcaaactcttttgttgcaagcgttccaactgttccttcaatgacatctagtcgttcgtatcgcaccattggtcagaccaattatgaacggcattcataacaggtgctagcgattcgcctttttcagttagttgatattcgatcaacgatgaatcggcactcgttattcgagcaacgattccggcttgttctaattccttcaagcgttcaactaacacacgatcactgcacttaggtacactatgaaccaaatgcttgaagcgctgtgcgcccccttctaataatacatcaatgatcagaccattccatttcttccctaaaattgagaatgttttttcaaatttaggacagagttggaaggtctcttgacagtcagaaatagcattttcttttacaatactcatcatctatttgttagtttgtgtcgcaattgattgatgtaataccttttgtttgaattttgtccaaaatggtgagcaaaattcggttaccgcacaatagtcatcgaccaatgacacgatataactctcccgatattttggatggctaactgtcgccccccacatatgtttgacaataatatctttttccattggtgacaattcggttagtttctcagcgttccggagtgcaatccgtgggtgcacataagcatgcgtcccaagatcgaacttcgtgtcacgccagtcgtagtagaacaaatcatgtaataagcctgcgcgggcaactgagcggacgttaagatgccacttcttggcaatctcgtagcttcgataagaaacactaagtgaatgttctaaacgatccgaatgatgatgctgtgtgtaatttgctaatttttgaacttcttctttttctaacaaatcggcaatcaatgccatataatctgcatcttgataccacttagctgttgcgttcatttagccttcgattaatttaaacattaaaatcccagcagcgactgcgacattcaatgattctgcattcccaggaattggaatataaaggttttgtgttgtggcagctaagacgtcttttgcaacaccattaccttcattacctaagatcaaagccatgtcagctgccttaggtacatcttgataactgatggcttctgggtttaattctgtcccataaactggcacgtcttgtgaattgaatttcttcatccagtccattaagttgccttgatagattggtaaatggaagtgactgccttgcattgaccgcaataatttgggattgtatagatcaacactaccgttccctaaaacgacaccggcaaagccagcagcatcagctgtccgaatcattgtgccgatattaccaggatcttgaacggcgtctaataacaagtaacgacccgttaatttttcaggcattggtgtttctgacatttcaacaacggcaaaaatcccttgaggggcttttgtttcgctaaggtgttgggctacttcaggtgcgatttcaaaagtatcgtcgtataaaccacgtaaggcgcgttcatcaacgtatttttctgtcgcaaagacttggtgaatcaccgctttattttggatggcttcttgcactaaatgccagccttctaataaataagtattttctttacgttggtttttcttaacggttaatttcttagccgctttaatcttagtattttggttcgattgaatgtattccatatgcaaaaagcagtccaattagatgtttttggtcgggttcaaggtgttggtttccggtggatgactaaactggtcgctgatcgattagggattactggcacggttgccaatcaacccgatggctctgtcaaaattattgcgatgggtcccgatgcccttttggaacaattcatcggtgccgtcaaagcgtcaccgacacccagtggtcgcgttgaccgcgtcatccaaacacccctgaaagatgtgtcagcgtgtcataaattttcagttgtcggttgaatgaaaaattcaaaacgcttcgcaacacttgcgatgctagcaatgaccgttacattatttctatccggctgtatgccacaaaaaatgagtagccatcctaaagtcccaaccggcttcatctatggctcatcgtacaaatacatcgccgtcccattacaacatattatggaacgcatcgctgatttcttcggcggaatcaatggttacggctgggcaatcatcatcatcaccttcgtggtgcggatgattttactcccattaatgcttaaccaatcaaacaaaatgactgcgcaacaagaaaaaacgcgtcgtttgaaaccacaattagatattgtacaagcacaacaaaaggttgcgacaacacctgaagaaaaagccgaattaagccaattaatgatgaaggtttataaggaaaatgattcaagtatgatgcctagccttggttgcttaaccttattaattcaattaccaatcttctctggtttgtaccaagccattcaatactcaccagaaatttcaagtagtcacttcttcgggattggcttaggtcaacctaatatcattatcaccattatcgcgaccctcttttacgttggtcaaagcgccctctcacttgttgggatgcccgctgaacaaaagaaacaaatgcaaacaaccgtcctcatgagtcctgcgattacattcttcatttcgttattcgcaccagctgggttagcactttacttccttgccggcgggatgattatgattattcaacaaatgatcacaaccttcatcatcatgccacgtgttaaaaaacgcattgatcaagaaattaaagaaaaaccaatcgtcacagttgtgacaaaagacatgttcactaaaaaagcagctgctaaagcgactgaaacacctgtaacaacagaaccaacgcacactaataaggcaacgacgccttctgaaacaggcaaacgtaactcaggcaaacaacgccacaaaccacaagcataattaattatcatcttctgatgtggtctttgtttctctaacgagtggtaattcaatccggaagactgatccgtgtccgacactactttcaagtgagacattaccatcgtagccttcgactaattgttgggcaatggctaatcctaaaccattaccgcctttttcccgactccgagctttatcaacccggtagaaacggtggaagacttttttcttatcttcttccgaaatcccctcaccaaaatcttgaacggcaacttgcgcgtaacgctcgtcgttggccaccgcaatatgaatttccttacgggttgttgagtatttaatcgcattatccaatagaataatcatgatttgttccagatgattccggttaattttgaccaacgcttgaccgcgcaaatcatcatccaaaataaacgtaaattccggataaagcatctcaaagttatggtagttttgtaagacaaccttaccaacatccgtcacttctgacgtgccttcggtcaccgcttgatcggcccgcgttaaatctagcatttcttggatcaaattcttcatccgtaaaatttcttgcagtgaggctgccagagattccgataaaacttccggatcatctttcccccatcgattcaacaattgaagatgcccttcaataatcgcaaccggtgtccgtaattcatgggagacatcactcacaaattggtcttgctgttcaaagtagtgctgaatccagtttagcatttcgttaaaggccacgactaagtccgagagttcgtcttggctgcggcctgtctctggaatgcgggcatccgaattcggttcaacgttaatcgcttcaatcgtttgcttcatcgcttcaatcggccgcaagaaccggttcgctaataagtagccaatcacagcactaaacaacattgcaaataacacaacgaccactaaaacaatccgtaattccagcatcgcatgattataatcacgcaagttattggtaacctcaacatatccgatggtgcgattcgtattagccgccttgatggggcgaatcccaattaaatgaatcttcccaaagatatgctcccgctttaacacatcggtatcttgctttggaaaagaggtggcccgaccacgcgaggcaaataagccttgccgattttgatcataaactttaaccgtcgtatcctgttgcgctaagcgcattaagacggaatcttgatagattgctttggattgtctcggcgctgggtcgagttgactcgtaacaaagtccgcggtcaacgctttttccgggcgggccaatcgttgctggatcacagtaaccgtatcatgaacattatcaacttccttatgcaataaaatgttcgaaatactactgaaaatcacaattgaaaaaatcgcaaaggtgataaaaatggccaacccaactgcagctgcccatttcacctttaacgatattttacgacccttattattattttcactgggtgtttctaagtcatttgttatcactcacgagcgcatcacatatccagttccccgaacggtttgaatatagctttgttcgcccgttcgatcgattttattccgtaaataacgaatataaacatcgaccacgttcgtttcaacgtcggaatcgtaaccccagaccttgcttaacaagacatcccgcgctaaaaccacgttgacgttttccattaaggttaatagtaattcgtattcacgtttcgttaattcaataatatcatcaccacgacgaacgattcggttttccttctcgactgttaaatcgcgataagtcaccgtcgtttgtttggcagcgttatgttcgccttcaatatcgatccggcgtaacaaggcgcgtagacgagccaaaagttcttcaatcgcaaatggtttaacgatataatcgtcagcaccatgatcgagccctgatacccgatcaatgacggaatcgcgcgctgtcatcataataatcggtgtatttttaacttgtcgaacccgtcggcaaacttctaacccgtttaattcaggtaacattagatccaataaaattgaatcccagtcttcgtttaaagcagcttctaaaccagtacgcccattgaaatgtacttcggtctcatagccttcgtgctttaattcaagctcaacaaaccgggctaaatttttctcatcttcaataattaatatgcgactcatttattgttctttgtaccatgtgtaatggaagatgccttcacggtctgtccgttcgtaagtatgggcaccaaagtaatcgcgttgtgcttggattaagttagcaggcaatacttctgaacgatatgaatcaaagtatgtgatagcagctgttaaaccaggcgcaggcacaccttgttggattgccaatgcagcaacatcccgaacagcaccttgatagttcttagtaatatctaagaaataatcatccaataataagttatttaagtcagctttcttatcaaaggcatccgtaatcttttgtaagaaacgggcacgaatgatacagccagcacgccagattttagcgatttcgccgtagtttaatgaccagtcatattgatctgaagccacacgcatttgttcgaaaccttgtgcgtagctcatgatcttactgaagtaaagtgcttgacgaattttttcaatcaattctttcttatcttcagttaacttagcaactgttggggcaggtaaaatcttgcttgcagcaacacgttcgtccttcattgctgagatataacgtgcatagactgattctgtaatcaatgattgtggcacacctaattcaagggcactttgtgaactccacttaccagttcctttgttaccagcagcatctaagataacgtctacgattggcttgtctgtgcctaaatcgtctttacgtgtcaagatgtcagctgtgatttccatcaagtaactgtctaattcgccgtggttccattctttgaagacatcagcgatttcttctacagataaaccaacaacgtttcttaacaagttataactttctgagattaattccatgtcgccatattcaatcccattgtggaccattttgacatagtgaccagcaccgttagggccgatgtatgtgacacatggttggccgtcttcagctttagctgacatttgttccaagataggggcaactaagtcataagcttctttttgaccacctggcatcattgaaggaccttctagggcacctaattcgccaccagaaacacccataccaataaagttgatacctgatttatctaattcggcattacgacgaattgtatcgccgaagaaggtgttcccaccatcaattaaaatgtcgcctttatctaataaaggtaacaattcgttgataacggcatctgtaccggcaccagctttaaccatcaagataatccgacgtggtttttctaatgatttaacaaaatctgcgattgtgtaacttgcaactaatttcttttcgctatgatcttgcatcacagcttctgtcttagcaccagtccggttataaatggcaactgtataaccgcggctttcaatattcaatgctaagttcttgcccataactgccatcccgataacaccgatttgtggttgactcatttaatcggcgtcgttttcttgtgcttctaacaatgctttgagcttagctaattctggattaggggcttcagcctcttctgcctgttgcttagcgtattcttcttcagagataactgaccaagcttggcccgttggcatcacgtcttcattttcttcttccggtgtcaaaatatgactcggaatgtgtaataagatgtgatcttcaacagccacttgcatgtctaacatttcaccttctaatgggaacaacatgtcctcatcagggaaacgtgataattcttcgtccgttggatcaacataaatttcagtgaacgtaaaatcaagtgggagtaccaccggattcaaactccgtgttgatggaacggttagttctccgaccacgtgtaagtcagcgatgatggcccgtcgatcaacggttaattgaccgctgatgacaaacggcgttgctgacaaaacatcattttctctttcgtggagttgtttttctaaatcaactgtttcttcaaaagcaagcggatgttcacgatgcttttgtaatgcttgtactgaccattttaacaattaacaatgcgcttcatcctttccatgataaaaaatcggttgtctggcaaagttttgcgactgccagccaaattgttctcgtaagcgatcaacgcggacttctaagcccaataaaccagtttcagcccccattttggcggaaaccttactgataattggtaaatcagtcgtcttcttcaactggtgtaagtgttgctgtccaatgtcattaaagcccaacaagcgaatataaggccgtgcaagcccttgttgaatatccgatggctgaatgtttaataagacatataggcaaacccgttggagccgggcatacgtatatcgttttgtttttaaggattgtaataagtcggtataactattggctttgtgaaccacctttttaaaacggtattccaagccctctgacatctggtagacctgccgtaattgtgctagtgacagactctcgatgcggtattttaagagtggccatagctggtcttctgtaagaatcgtactatccgctaaggctgctagggtttctgctgggacaacgtgttgtaaggtcgctaaatcggtatcttgcgtcacaattttgcgaatcgcactcgcacttgcatacggtgccgtcgaaatggtctgatccccatgttgtgcttgttcccgcttgatagccaataagtttaacggttgcgctagacgtgcattagcgaccgcgtaactgattcctaacaagtggtttggttgatcaatctgcaaggataactgttcttgatagaactcgttaagctgcgttgcgtacgttttttgatagtcaacaaaagcagcagattgctcaggtaagtcgataatctgctgccccgcttgttgataatcaaatgccggttgctcactgccaaaggcaattgtctgacagccaagtgccgctagcagttgcactgcgccagtcgcaaaacgatctgctggttgcaccgcactcacaaatggcaattcgaccaccatatccgcaccattttgcaacgctaatttggctcgcgtccacttatccaaaagggctgcttgcccgcgctgaacgtaattcccgctcatgcagataatcactaaatccgctttggattgctgacgcgcctgttgaagttgatagatatgcccattatgtagcggattgtactccgcaataattcctgtaattctcatctatttaactgcgctaaagaaccaacgaacactgtcatcttgaaccgcttcttgaccaaaatcagcgctgactttaatttgtttaaagcccaccgcttctaaagccgccacaaagtcagccattggatacgtccgttcatgatgtaattcgtttaattcttggtaaccaccaagttgttcgtcccaaacgaagaaggttaaatcatgttcaactgaatgaggcacttcgccttcataactcgtccacataaaggccgtttcttcggtccgatcattatacataaaaccggggaataaaacatccatttgatagagtgaatgcgcatcaaataagaattgaccgccctctgccagttgttgataaacctgtttaaagacttgttggacctgatccaaatcttgcatgtagcagattgaatcatcaaaacaagtaatcgcatcaaatgtgcccacttcactaagatctaacatgtcgccttgaagtaatgggaaactaacgcccgcttcagtcgctttttcagacgcaatactcaacatttctgttgaaaggtccaagccaacaacgtccagtcctgcttgctttaaaaggatggctaaatcgccagccccacaagcgagctctaaaatgcggtgttgattttgcaacgtttgtaatgtgtaatcacgccattgaccatataattcatgatccattaagcgatcatagaccgttgcgaaactttgataaatcattcattcttctgttaaccattctgaaacatcaaccattggtgcttcatcccataatttttcaaggttgtataatgcacgttcttctggcatgaagacgttgatgacaaggtcgccaaaatccattaagatccaacgtgagccttttttaccttcaattttcttaaccatcaaaccagcttcttcttcagcatcttcaatagcgtccacaatggcgtctaattgacgttctgaagaaccagtcatcatcacgaaataatcagctaataaactgatcccttccatgtttaatgccacaatatcttctgctcttttaccgtctgctgctttaacagcaatttttaataagtctaaacttttcacttaatgggcttgagttggcacccaagcattgtatgtgtcaattgttttaggataaatcttcttttgcccttcaattaaaaaggtcaacgtatttaaaatttcaaaccgcacgccagccgctaaatcagcgaaggcagtttcccgcgcttgtgccacgcctggaaaatcacgacccggttcgatgaagtcagcaacaaataagatttgatcgatgactgtcatctctggggcgccaatcgtatggcgacggaccgcgtttaaaattgtttcatcgtgaatgcctaagtcacgttcgatgaagtaagcaccgacgacaccgtgccaaattgcattaccgtattgtaacaattccggatcaaagccagcttcatgaatcgcttcaataaagacttcgtctggtaattgcttggcataatcatgcaccaaaccagcaatcgctgcccgttcaacatcggcatgattaagctcagcgagcttaatcgcagtctcttcaacgcgtaaacaatgttgaaaccggctctcagataaattggcagccactttttgcgctagttctgcgcgtgaatacggcacaatattttcttggtaagtaaaatcactcactcactcacggtataacccttcttcctcaatataatccgccactttagtcggtaccaagtagcgaattgaacaactctgttgcaccttattgcgaatctgagttgaactaatatcgacaagtggtgcatcaacccacaacacgggataaggcgtgtcgcgactgtagcctgtccgttgaatgccaacaaactgcacgagttgcactaaatcatcaattcggtgccaagtcggtaagtaatcgaccatatcgccaccgatgatgaaataaaaatccgtattgggatattgtttctttaacgccacaatcgtgtcatacgtataactgacaccaccgcgttcaatttcagccattgataattcaaaaagtggattatcggcaatcgcccgtttgaccatttcaacgcgatgtttggcgggtaacgtttttttggtatcgacatgtggcggggtcgcatccggcatgaataaaactttatccaaacctaattgcgtccccacttgttcagccatgatgagatggcctaaatgtggtgggttaaaagtgccacccatgataccgacctgttgtcgttgtttatcttcgacaactaagacagacggttttgactctgatacaccgtgcactttttttaatgttgcattttgcatttaacgtccgagcttagtaacaatcgttgaaattttttggtatttttctttacgtgatgccttataaatgaccaatgtccggccaattttttgggcaatttcaatccgattatcatgttgcttcaagaagttggctaattcatcaaccgttacctctgttgtttgcaataaattaatcttgattaattctcgtttttcgatagcttcttcgatttgttcgaaataagcttctgacaaaccattcttacctaattggaataatggttttgttgtttgcgctaatcctctaagatagtgcttttgtttacctgttaacacctaaataagtgcttttctgatcatcactgaaacgccttttggtgcgtaccctgcgacaaccacattttctggtaatgtaatccagcctaaaccggcgaagactaaatcacttttttcttttgttgaaaattcataacgttgtaagtctggaaaatccgctaagtcttctggatgaggtggctgtaataaatcacctaactgtctaacatagaaattatccgcattttctaattttgttctgtggatgtaaagttcattatcaaagtaaccaacaaaaccgtgacgaggcccttgaagataatcaaaacgtgccaagccgcctaaaaatagcgtttgttgttcatttaattgataaactttaggcttgatttgcttttgtggggcaatcaaacgaagatccttatcatgtaagtaatgcgccatttgttgcgcgtgaataatccctggtgtatcaattaaagcatgatcatcttcatataatggaatatcgatccgatccaacgttgttcctgggaattgtgacgttgtaatcacgtcgctgtccaaaatcccagtttgtttgatgatgcggttaattagcgttgatttaccaacgttagttaccccaaccacgtatacgtcgcgaccttttcgttcccgttcgataactgctagtaagtcatcgactgagttcccttttttagcgctgaccaacatggtttcaattggatgtaagccatgttccttggcttctttttgaatccagttgatgacgcggttaggattaagggctgttggtaagatatcgaccttattgccgaccaagattactgggttatcaccgatgaaacggtgtaatccgggaatcaagctcccgttaaagtcaaagatatccacaacgttgacgattaaagcatcactatcaccgatttggttgagtaacgctaaaaaatcatcatcgtttaacttgatatcactgatttcattataatggcgcaatctgaaacagcgttggcaataaagctgacccgtttccaatccttttttaagggcagaattaggggtatagcctagtgcttccttatcagtcgtttgaatctgagcaccgcaaccaatacaaaatagtgcttcttcagtctgttgttgttcttcagtcattcagtcatttaaatcctcccgccaagttaaatctgcgtgtttttttagtagttgttgcataatatatttttcaaaaaagcgattaatagaagtattccaagcgtcactatcaataattggtttcactaagattgtccggacaccggcaatattgcctgcgtgcatatcggtaatcaattgatccccaaccatcaccacttcgtgacgtgataaaccgagttgcttcttagctttcacaatcccagtcgccaatggcttattagctctggcgataaaaggtaattgtaattcggccaacgcgtgttggacccgttgttgattattatttgaaaccaccatgaccgtaatcccagcggcttgcatttgtgctaaccattctttgagttgcggcgtgccgtttgggttattccaagcaattaaggtgttatcaagatccgtcaaaacggctttaatgccttgtgctttgagttgttctggtgttaagtcatagattgcattaaccatccaagttggcttaaaattctttagcatatggaaaaatttgggtttaatcattttggcggaccggatgtttttgaaacattgaatcaatcgcaaccagtgccaaaggcaaatcaagtcttgattaaagtactcgcatttgggcttaacccttacgatgttgcccttagaaccggttcacaacaaacagtgcgtcctttaccaatgccaatcgtccctgggacagatgtggttggtgaaattgtaatgcttggcgcagacgttaccgattatcgtattggtgaactagttattaatcatcgtccactcggcggttatagcgaattcgtcacagcttcaaccaacaaaatcattcgcaaacctgtcagcctcagcatcgctgaagctgctggtctcgcaagtgctggtattaccgcttataacacgttaatgcactttacgaactttaaacatggcgatacaatcgctatcatgggcgctagcggggctgttgggagtttactcactcaactcagcctagctgctcatttaaacgtcattgcaattgcacacagttcaaaccttgattatttacgatcatttggcgttcaagaaacaatcgcctatgaccaatcaggcgatttaagtcactttaaacaaacggccaagattgctgtcaacctcagccgcgatccaaaatcaactgaattattgaatgaacttgtccaaccagatggtttctttgcaagtacaacaatcatgccaagtgaagcagaacaaatggctggtgtcacttaccaatctgtctaccctcgccgtgactatcctgatttaacagcccttcaagatttaagtgaacttattgatcaaggcctattacacgtcacagtccttgaagaattacctttcacacttgaaggcgtcatcaaaggccatcaacttttagaaagtcaccatgcaccaggtaaaatcatcgtttcccgttaattatttgtttaatgcagctttagcagcttcaacaactgatgtgaatgcagcagcatcgttaacagctaagtcagctaacatcttacggttcatgtcgatttcagcgactcttaaaccgtgcattaattggctgtatgacatatcgttcatacgagcagcagcgttgatacgagcaatccataacttacggaagtcacgtttacgttgacgacgatcacggaatgcgtaacggtatgaaaccattacttgagtatttgctgatttgaataataaatgtttagcgccgcgataacccttggctaattttaaaatctttttacgacgtttgcgcgtcactgttccacctttaacacgtggcatttatttaaggcctgataacatttgacggatacgtctcatatcgctatttgaaaccattccagattttcttaattgacgacgttgtttcttagtcttaccgtggaaacggtgacttgtgtaggcgtggctgcgttttaggccgccattacctgtacgtttaaaacgttttgctgaagcacggtgtgtcttaaattttggcatttatttttggtccttaagcggttctaacattaagaacatgctacggccatccattttaggacgtgctgtaactttagcgatgtcctctgtttctttagcaagtctttctaatacacgttgaccaatttctttatgcgtaattgctcggcccttgaaacgaatagaagctttcactttatcgcccttgccaaggaacttacgtgcattgttcaacttagtattaaagtcattttgttcaattgtgggactaagacgaacctctttgaggctaatggttttctgcttcttacgagcatcacgttgtttcttttgaagctcgaaacggtacttaccatagtccataatacgagcaacgggtggttttgcgtttggtgaaaccaagacaacatccatattagcttgttcagctaatgcaattgcatcctgtgtactcttgataccaagttgttcgccatcttgagcaatcaaacgtaattctcgtgcacgaataccatcgttaaccatttaattaccatagtgattatcgattaattgtgttgctttcacttcatcaatattatgcgtaccagcaagttgcataacgagttctaattccttttgtaaatattcaaagacgttcttaacaccgatactgccacctaatgctaaaccatagattacaggccggccaattgcaacaatgtcagctccttctgctaaagccttaaagacatgttggccacgacgaaccccactatcaaagacgattggcacccgtttgttaacagcttttgcgaccacgtgtaatgagtcaaaggctgcagggccaccatctaattgacgaccgccgtgatttgaaacccaaatacctttagcgccggcttgaagggcaatttcaacatcttcagcagtttggattcctttaacgaagactggtaaatgtgtgtattcggaaataaatgcaacatccttaggattcaaacgttgcttagctgatttgtaaacagcatccattgtttggcccacacctgtttgataggcttcaacaattggcaaaccaactgggaaagtaaaatgattgcgcttatctgtttcacgattaccaccaactgtcgcatcagccgttaagacaattgctttcacattatgagacattgcttcgtctaatattttgcggttgatatcattatctttgctcatatagagttggaaccattgtggtgcgccatcagctgctgttgccatatcatcgatacttgctgaggcaaatgaactcatcgttaaaagtgagccatattccgccacccctttagcagttgccacttcgccttgcgtattaactaacttatgtgcggcaacgggtgccatgatgattggtgctgttaaatgatccccaaaaatttcggttgatgtatctggattttcaatatcttgtaagacgcgtggtgcgatatatttatgattaaatgctgtgatattttcattaatggtatagaggtcacctgcaccactatagatatacccaaaaccgcccttagggacaactttaccagcggcttcctctaattcatagagattgataatatccaatgctttttctgcagaacctgccatatatttttcagttgccatttatagattaatcttctttgtgtgttgtttgccgtctcggctatagttaccaacttctgctacgattgcgttgataaacatgtctgaggcttcttcaaccgcattttcttcaccgtatttacggacagaaactgttgcttgtgcaagttcttgatccccaacaactaatgtatatggaatcttgcttgtttgggcttcacgaatcttataacccattttttcattacgatcatcgatccgaacacgtaaaccgcgtttgatcatttcatctttgatgtttttagcgtaatcatagtgaagatcgttcttaactggaatgataacagcttgtgttggtgctaaccatgttgggaaagcgcccttgtagatttctgttaagtaagctgtgaaacgttccattgttgacactaaaccacggtgaatcataactggacgatgcatttcgccatcttcaccaacatagtgtaggtcaaaacgttctggcaacatgaagtctaattggattgttgaaagtgtttcttcattccccatagccgtctttgtttgaacgtctaatttaggaccgtagaaggcagcttcgccttcagcttcgacatagtctaagccaagatcatccatagcgcccttcaacattgcttgtgctttgttccacatttcatcatcgtcgaaatatttttctgtgttagcaggatcgcgataacttagacggaatgtgtaatcattgatgttaaagtcagcataaacatcgatcattagccctaagattgatttaaattcatcttgaatttgatcaggacgaacgaatgtgtgaccatcatttaaagtcatttcacggacacgttgtaagcccgaaagtgcacctgatttttcataacggtgcatcataccaagttcagcaatccgaattggtaattcacggtatgagcgtgggtgatgtttgtaaacttggatatgtgatgggcagttcattggccgtaattcaagcatttcgccatcgcccatgtccattggtgggaacatgtcttcacgatagtgatcccagtgacctgattgtttgtacaagtctaagttagccaagattggtgtgtaaacatgttcgtaaccattagcaacttctttgtcaatgatgtaacgttcaattgaacgacgaattgtagcaccatttggtaaccagtaaggaaggcctgcgccaaccttaggatcaacgaagaataagtctaattgattaccgataacacggtgatcgcgttccttagcttcttgacgacgtttcaaatcagcatcaagttcttcttgtttaggataagctgtcccgtaaatccgttgtaacatttggttacttgatttaccttgccaataagcaccagcaactgataataattcgaagaatttaacgtcactgactttacctaacattggtgctaagctaaagtctgagtagtcacctaattggtaaactaaaacttggtcagcttcaacttcgtctaataaagcaagtttataagtttggccggcaaataatttcttagcgtcatcttttgaaacactgacacgtgaaattgcttcacctgattggattaatttagccatttctgttttgatttctggtaaatctgttacagcaacttggccagcttcattatctgtatcgtaatagaaaccatcttcggttgccgttacttcaccaaattgcatttctggatagtgttgacttaaagtagcagctaatacgaaagctgcagtatgccaagtggcagttaggttaaccgcttgatcatctttagtgatgatttcgattgccccgtcttccaaaagtggttgttgtaaatcaaccacttcaccgttaaattttccggcgattgccttttttgccaagctcgtactgattgattttgcaacgtctagtaaactggttgcttgctcaaatgttttttgagcaccatctggaaaagttaattgaatttctgccatctaatttgattgtaagcgtctattttgaccactgacctcaacctcacgggctaaataccgcacccgttgcataattcgaccagccttcaccggttcttcatcgccgcgttggctagttgttaaatgtttctccaattcgttcatcgtaaaattagagctgaagaaagtcgctagttgttcttgcatccggtattgcaaaataatgcctaatacttcatcccgaacccaagcactcaaggcatccgcaccgatatcatcaatcattaaaattggtgcttttttaatttggttgaccttttcgaggacgttattttggccaatcgcatttttcatctcaactgcaaaggttggaaaatgaattaacgtcgtttcaaagccttgcagtgctaattcattagcggttgcgcctagtagatacgtcttaccaacaccaaactgcccgcttaaatataagccttgatgaaaatcagtgggtgcttgccgataagcttcgacaaacttcaacgcttcgattaacggtacttggcgttcactcgcatcatactgtgcgaggctcgcttcgacgatgtccttaggcatgttaatcgacttcacacgggccttcagttcggcttgtgcgcgcttttgaactagatccgccgtgggttcataactaacatcgataaagtggttactcaacaccaacttaggcgcatagcctggtgccaacgttgtttcaccgtttaaaattttctttttttcattgacatattcatagattttagccgcactgcgcgccactgtttcttgtgatagggcggcctgattagcctgaataaaggcctgcacatcaggatcttgcaaggcttcttcaaccaatttattaaagcgttgattcaggcgttgccggttcatatagtcggttaaatctttgcccatattttccatttatgattcccgcccttcacggattttcttgagtaattgatcaatttcttgctgatccgccttacttgatgtggtttgtggcgcttgataatcagacttggcccatttaggcacagtttcttgcttggtcttggcttgatagcgcggttgtcgtttagtttgtttcgtttcttgtttggtttggaaatcacggatttgtaaaatggcgtcagctggcgtcttaaccccttgttgcgcccattggttggcgattcgatctaacaaagcttgtgttaggccctcatactgactaatgatgtaaaccactaagatatttaaaacatcgttgttaaagatatagcgattttgtaagtcacgtaatgcgcgaatttcatttttcgccacaaagccatgatttttttgcttaagatattccaaataatcaactggtaaatactgctgactttcggttaaccactgcatttctttttcattaaagccggctttttgccattctttttgcagcgtctcaagtggttttttagccggttgttcactgttattttgaacgctatgtcggcgcgtatagttattcaaaacgttttgttctaacgcatccatattgacccgactgtcggcaacatccatggtgaggccgattaagcgtcccaattccatttcgtctaatccgtaaaaataatgcaaattaaataatcgttgctcattacgtaaaatttcatccgtatcgatttgattctgtgcaaccacttcttgcaacaaagcccaatcaaaagtgcgcaactcaactgacgtgaaacttggtttttgcgcctttttttgttgatacgtactttgtgcctcagcaactgccgtaggggccgttgttaaatgatcattttgaacgtggaagaccgtcaagaagttcttcgtgacctcttcgtattccttagagcgcactggttgtagtttaaaatgctctctcaattcaataaaccgcttctcaccgactgattcgtataaaatgacactcaacaaatcatcattgaagaaaatatgcggctgcatcggtgcgtataattcatacaccagattgcggcccgtattgttattcttctgataagtccgcattaaacctaacgcttctaacttattgcgcgcgtcataaaaagccggcaaatcaacccctaataaattcaacaaggtcgcatgcgtttggaaagtcgtttgactcttggcctgtgttgattggctccataacaaaagatagagactgtacgcaacagcccccatcagtggttggtataaataggtgacgactgtttgatcaaaatcgctcaaatagttagcttttgtcaccataaacccatctttaggacttaaataatcaaatgcatctgacatctaatcttggtctttagccttttcttttttcatcatttcttgtaattccgccatgaagacgttcatgtctttaaattgacggtagacactagcaaaccgaatataagcaatctcgtcaacacctggtaagacagccatgacgtattcgccgacagcttgtgacgacacttcattttcgcctaacgcgcgaattttattttcaacttcatcaacaatttcagtcatttgttccatcgtaaccggccgcttttcagcagcccgaattaaaccacgtaataatttatcgcggttaaactcttcgcgcgttccatttttcttaatgactaataacggtgtttgctccaccctttcaaaagttgtaaaccggaattgacaattttcgcattcgcgacgacgccgaataacgcgtccttcatctgttggtcgactatcaattacccgtgaactattttgatggcaatgtggacatagcattcaggacatacccgacttatggcgcacgccttccaaaactgtctttaattgggcttccaattgatccagtgaaccttggttatcaatcacgaagtctgctctatcccgtttttcagccaatgatgcttgactgttaatccgtttcaaagcatcttcgcgacttaattggttccgcgccattaatcgcgctaattgtttttcaaccggcaaataaacgactaacaccccgtcgcaaaccgtttcgtagtgctgttcatataacaacggtaagtccaaaacaactagcggtacttggtgcgctttggcctgagccatctcggtcataatcgtctcccgaatgaccggtgcggtaatcgcgttgagttgcgctaatacggcttgattgccaaagaccaatttgcccaaagctgcccgatcaactttaccgttttgcacaagctgcttcccaaaagtggcttgaatctgttcttgcacactttgattatccgccaacacttggtgtgcgacttgatccccatcaataataggaataccttgtcgcgctagcatttgcgaaacagttgttttaccggtagcaataccaccagttaagcctaggaaataagtcatttattttgcatcccttttaatctgacactttggacaaaaatgcgtcccccgctgtgccactttaatcttctcgattggtgtcccacatcgttcgcaaggaaccccttttttgccgtaaacatgcagcatttcttggaaggcgccagcatgaccggtcgcgttcaaaaatgtgttaaccgtcgtccctccatgattaatcgctagttctaattcggcaataatctcatcgtggaggcgatccgtttcagcacgcgtcaagtcattggctggtatttctggatgaatatggcttaaccacaacgtttcatcgacataaatattgcctagaccggtcacaaccttttgatccaataacaatggcttgatagctttgtgatgtttttgcaaccgttgatagaagtccgcctttaaaaaggtcgtcggtgttggttccggccctaggtccttcaagccagctaccgtattttcctgaccggtctcaatcaactgcatccgcccaaacttccgcgtatctaggtaacgcatctgttgcccatccgtgaattcaaaaatcacgtgcgtatgttttgaaatcggtgcctccttggcgaccacttcatacttaccttccattcgcagatggctgacaacagttagctgttctccaaaacgaattagtaaatatttcccccgccgatcaacagctgtaatctgttggcccactaatccagcagtaaagacttcatctggattaacaatgattttcgaccagcgaatatcgattgctgaaacagttttaccaaccgctaaggtttcaagtccccggcggacattttcgacttctggtaattcaggcatttatttcttaatatcgtaccaagttgggccaaaaccactttcgaccttcaatggcaccgctaatttaacggctgaatccatcacacttgggactaatttttgtaagattggtatttcttcagttggtgcttcaaaaatcaattcatcatgtacttgtaataacattctggcttgcaagttcgccttcttcaattcttgttgcattaaaatcatcgccaccttgataatatccgcagcactaccttgaattggcgtattcatcgctgtccgttctgcaaaagaacggaggttaaagttcttagcgtgaatatctggtaaataacgacgacggtggaaaagcgtttcgacatagccttcttcacgcgcttttttaacaatatcaaccatgaattgttgaacacctggatattgttcgaaataagcgtcgataaagcgtttggcttcttgccgcgaaatgccgatattttgagataagccataatcgctaatcccgtaaacaatcccaaaattcgtagctttagcttggcgccgcatatctggtgtcacttgatcggcactgtttaagccaaagatcttcatcgctgtatttgcatgaatatcccggtcttctttaaaggcttcttgcatgttggcatcccctgagatgtgtgccaatacccgtaattcgatttgcgagtaatcagaagcaaacatttgccagtctgggtgacttgggacaaaggcttggcgaatcttgcggccttctgctaaacgaactggaatattttgtaggttaggatcaaccgacgataaacggccagtttgcgtcaaggtttgtaagtaacgcgtatggactttattatcttgatggattgatttcaataacccttcgacatacgttgattgaatcttggtaatttgacgataatccaaaattgtttggacaattggtgcatccttccgtaattgttcaagtacatcaacagcggttgaatagcccgtcttcgtcttcttaatcactggtaagcccattttttcaaataaaatgacgcctagttgcttaggtgagttaatgttaaaggtttcgccagcttcagcgtaaactttttcttccaagatcttcaaggtttggctgaattccgatcccatttgttggaggcgactggcatcgacccgaatcccggttatttccatttgcgccaatacgagggccaatggtaattccatatccgtaaagagatcgaattgttgatgttccttcaattgttcttcaagttgtggttgtaaatgataaatggctgccgctttttgaaccaaatgttgatacaacaaagctggttcagttggaacagcccgtttagcacctttcccataaacggcctcgtctgtttgcacattttgatactcgtgtaaattagcgaccgtccctaaatcgttgctgttattcgtcgtattcaataaataagatgctaataataaatcaaaattaacgcccgctaaatgaacacctaatcgattagctgcgacttgcgtccgtttgacatcgaagactgctttaggatgactcgcatcttccaaccaatccttcaatactggttcagctagtagtgcaacatcatcactgacataccaatgatctggtgcgccgatataaaaaccaattaaatcggctgtgtgataattatcggttaacatttcaaccccgaaggcaaccggtgttttaatcgcttgaacggtttctaaattatccaacgtcaaaacagtatattgatagttttccgccggttcaaccgcttctggtgtcacgttcaattgctttaaaaagttttgaaagttcatttcttgataaaaagcaatcaacgtatcgatgttgggaccttcatacgtgatgtccgctaacgtcgtttcgatcggtgcatcccgtaaaattgtcgccaattttttgctcataaaggcttgatcacgatcttcaatcagatgttccttcatcttactctttttcattgcatcgacattttcgtagaccccttcgatgctcccaaattccgttaagagtttcagcgctgtcttctcgccgacctttgtgacacccggataattatcagaagtgtcgcccatcaaaccttttaagtctacgatttgactaggtgctaagcctaatttttctttgacgtgtgctggcgtgtaggcttctgtatcgttgacacctttgaccgtgatgttgacagtcgttttgtccgtcgttaactgggttaaatcgcgatctcctgttacaatattgacgacaaagccgtcttgttctgcttggcaggctaacgtcccgataatatcatcagcttcatagttcgctaattcagccgtctgaataccataagcgtgcaatagttccttgatatatggaaactgttccgtcaattctggtggtgtcttagaacgcccacccttataatcggcaaattgtgccgttctaaaagttgttttgcccgcatcaaaggccactaaaacatgtgttggttcaaatcgtttcaagataatatcgagcatatttttaaacgcataaatggcgttggtatgtaacccatcttgattggtaaaactatctaacacttggtgcatcgcgtaaaaagcccggaatgccacactattaccatcaattaataataaacttttttgagaacccatttattttgcgtctggtcgattaaggttcattgacaccattcgttcaaagatttctttactttgaccgatagtagcatcaactttatccttgcccacttcgtttttaagatcgttgtatagatctaaatagtagtaaagcaagtgattgtaaacttgtaatcctttttcagttaaatgtacccgacgaatccgttgatctttttcatctgattgttcagcgataaaagccatctttcgtaatgaacgacattggcgtgaaatcgcagaacgactaacttgcatcttatctgctaaagcactattagttgtttcgttattgttattcttaatctcgtgcatcactaagaattgatcaaatgataatccatatttttgactttctcggttcatcgattcgctcaaattattgatgagccaacgatataatcctgcgaattccataaaatcggaccatgaatcaccgattaggtcggacttattagttgcatccatctagacttcattaggaagcgtcacagtaaaagcaagaacctgatgggtcaaatcccacaaattaactgtaatcgattgggggataaggccatcagtatcatagtgacagctagcttcatatttgaattcggtttcagcttgctttttgctcaaaataattcgtgtggctaattgttcaaaatcgtctaacgaataatgcgtccctactggttcccctggcacttgaacattatttaggaccaagcgataatggttattttgataaatgctatacaattgatttacccgtgcttgattactcatcatcaagtaattcatttgggggcgatcaccatgattcaaatgtgctgtaccagtaaataataacccatcaatattatcgccttctgaaagcgtaaaacgaaaaggcaacaaatgtgtgcgatgatacaaattaattttttgtccagctacctttacatagtcgtggctcactaaatcataacctggcgtgtaagcccgtttacgctgttcatcactgcgcttaacgataccggtttgaaccattgcttgccgagcccttaacatgccggtcgtcagaagcgcaatggccccaataggtcgtccttgtggcatttcagcgaccaatacatcaccaaggacaccaggtttatctaattgattcatggtctgttcaaaatgagctgctgttatgtagcgatacttgacttgcgcgctatccaaaagtgcttggttctggctagtatcatccacttcatcctggccactgtgatggcgtacaaattggtatagtgcataacctaaccaaatgacggccgcagcctccattaagggttgctgccaccatttcccaaggttatacaaaagcagcattcctaaatattttttcatttatttaataatcgtaattgcaatatgacgtcgtccccaactgaggcattgggcaacacttgggaagtgaacatcaataatgtggcccttaatggcaccacccgtatcacctgcaattgcataaccatatcctggcaccaaaacaagcgaatttaacggaataacttttggatcaacagcaatacaattaggttttttcaccaaatcaatgcccgttgcgccgtagcgacttaagcctggttctgccgttgaataagccgtcgcttgcacttcaattgtctgtccgggctttcctttggcagcagcagctagcgcggcttgttgttgattattgactgctgataatttttggctagcagctttagcggcagcctcatttttcgccttagcagcggctttagcttgttcttcagcttctcgtttttgttcttcaatcttctttttactaatatcagcaagttgtttttgactctggctcaagtcttttttcatctgatcgacttgcttttgtaaatcagccgtttgctggtctaaatcctttttttgtttgtctaaagcggccttactttcttctaagtgtttttgaattgtcaccattttctgataactagttgctaaatcagtcatattttgattatccgcatcttgtagaatcgtcaaagtgtagacgcgactaaatagatcactcaatgaatcagccgataataaagtatttaagacatcccgattatcttctgatttttgtaatgcctgcaagtgggccttggcataatcttttcgttccgccaattcctttttttgagccgctaaaatcgtttcggccttattaatatgttcttcattttctgtaattttcgtttttaattgatcaacttcttgatatttagtattcactttggttaacgtgctttgaattttaccgttgatcgtatcgatacttttttgtgtttgatcttcttgttgttttaattcactaagactggcagcgctgactggtcctgctgtcgtcacaataatcatcagccctgtcagaatcattaaaccgattttcttgaattgcatttagcgttttcgtagtgctcttgccatttcacgatcttgttccttacgcttgagtgtttctcgtttatcgtattcccgtttcccttcaccaacgccgattaagaccttagcaaaaccgtgttttaaataaacccgtaacggaacaattgtaatccctttgtccttagtcaaagcaccaattttagcaatttctttcttgtgtaacaataattttcggttacgcaatggatcatggttaaattggttaccttgttcataaggactgatgtggacattttccagataagcttcgcccttgcgaacgcgcgcaaacccatcacgcaaactaatttttcccttacgcaccgatttaatctcggtcccggttaaaactaatcctgcttcaaatgtctccaggatattgtaatcatgcccagcttttttgttttgagcgattaagttagctggtttttgtggatgtttctttgccatctactttttaaaagtacgtttttgtgagtcctttttagccactggtcgtcttggatgactgtttttcttttggtcaccacgtcgttgaccgcctttttcatggtctcttggacgagttgggcgcttaggtcttgcttctatcttactcaaaatttcagcagaagccaagggaacttcctcgcttgctaataattcgaagtctacagaatgtgcatctaagtcaacattagcgactttaacccgtactggttggccaattcggaacattttatgggttctttcgcccactaaagccaattgactttcaacgaagctataataatcatctttcatttgagagatgtgtacaagcccttcaaccgtacttggtaaggcgataaacatcccgaagcttgtcacagaactaataacagcatcgtattcattaccaaccttatcaagcatgtattcagctttcttaaggtcaacaacttcacgttccgtatcaattgagcgtcgttcttcaagtgatgtttgttcagcgatgggttgtaacttaggtgcccatttttctttttcttcaatcgtcatgccatttgttgcataactatgaattaaacggtgaaccattaaatccgggtaacgacgaattggtgatgtgaaatgcgtatagaattcagcagccaaaccaaagtgaccaagtgattcatctgaataatgtgcttgttgcatacttcttaataacattgttgtaataatgggttgttcaggttgaccttcaatttgcgtcaagacttcttgtaacatcataggtgttacttttttgcttgagccctgaacttgaatgccataagcggtgataaattcgaagaagttcttcatcttatcagcatctggtgtttcatgaatccggtataagaaaggtgcattagccgtactgtaatgttcggcaacagtttcattagcagccaacatgaatgattcgatcatgcgttctgaaagaccgcgttgacgtaattcgatatcgattgccttaccgttttcatcaacgatgattttagcttcgtcttcttcaaagtcgattgcgccacgattatgacgtttcttcaagaggatttcgtgtaattcagccattgtttcaaacattggcaccaaacgtgcgtattgatcacgtaagtcagcatcttgatccgtcaaaatcttattaacattgttataagtcattcgagcggttgatttgataacacttgggaaaatgttgtgatcgaccacgttcccatgttcgtcaatttccatttcacaagtcaaggccaatcgttcaacgtctgggttcaatgaacaaatcccgttagaaagacggaatggtaacattggaatcacgcgatcagttaagtaagtacttgtcccccgttcgagcgcttcagcatctaatggggaaccttcggtagcataataactaacgtcggcaatatgcacgcctaagtagaagtgaccattgtccaattgacggacattaacggcatcatcaaaatcttttgaatcgtcgccatcgatggttacaactggttggtcggttaaatctttacggccaaacttatctgtttctaaaacagtatctggaatggcttctgattgtagtcgaacttcttctgggaaatctgttttaatatcatgttggtaaacaattgataaaacatcaaccccaggatcgtttttattccctaagacttgtttggcaatcccgcgcatttggccaggggtatcgatacttgggtatgacgtaatatcgacttgtaccatatcgcctttttgagggtgtaaaccgttgtctgttaagtaaattaaatagctgcttaattttttagcatggctttgaatgtaaccaatcaagccggttttttctttttggatatctgaataaggcatgaattcgccgacgatttcttcgatgccccgcgtaatcactttagccactttcccttcaggcccgcggcggctgttttcttctgcttctttgatgatggccacttcaacagtatcaccattcattgcaaagtttgtgtttggtggggcgataaaaatatcgggatcacttggttctttatcaaccattgagacgaagccaaaaccccgatcgttagcgtggaaaaccccttcgactaagcgttggctagctggtaatctgaatttaccggcatcatccattaaaaggtgcttgtccccttctaattcggctaatactttcactaaatccttgaacccttgtgagccggccacaccggttcgttcactaatttctgatacgtttaattgttgcgtttcatctgctgcaaaaatggctaagatggcagctttcatttggtcaacttgtgtcaattatttcttataacgtttaataaatacttcaacatctgcttctaattggtggtgcgcccgatcaaccgtaatcacgtgaccggcattgtcataccagtgataatcaactggtgtttgttgtgcttctaagcgttgttttaatgctgatgcaccgttaggatcaatcacttgatcttgaccaccttgaccgataaagactggcttatcaccaatctggtctaaatcggcggtgactaacgcgctaaaatcagcgattgcttgtagttgttgtggtaattgttgcttaatcttagccaattgaacggcttgatcagcggccgttttttcggtaatctgataaaggcgttgcgcatagcccataaatagcggtgctagtttatcagttggtccttccagtactggcgcgctaaaaataccgccgcccaccaccgctggcatcgtttcgattgcgcgcatcgcgaacaacccacccaatgacaagccaaacacaaatagtggtttcttggcagcaacttgtaacttctgaatggcagccgttgtatccgcccaccaagcttggacactaccttcttctaagatatcaagtggttcaaaagtggcgtgccccgtaaagtgcggtgcaagcacactgatttgctgtttctctaaaaaacggcccatcatatgaacatcattagcacttcctgtgtaagcgtgcaatagcaccacgccaactgagccactatcataatagtaaggttgtggtaaccgatactgcatttagtgtgatgataaataaactaatgcaattgcaaagacgaagaataaagcccctaaaacgacggtcactttctgcatgaaagcttcaaagccacgggccttttgcttaccaaataaatcaccagagccacctgataatgcgctcaaagcatcctgttgtttacttggttgcatcatgactgcgatcacaatcaagattgaatcgattaataataagttcaggataagattttccaattatttcacgagattctcatccgctttttttaaggtttgggcagcggcttcaatctgtcgccgcacggttgctcgtaagtgatgatcggttaaaatgaccaaggtgtcacccgcgcgaatcagcgtatcaccatgcggaatcaattccgcttcgccgcgccgcacggcaattaataaacatgtttccggccaagcaacatcgcggacttgatgatcttccaatggtgccccggcaaaaatcggtacttccaaacgatctttaaattgtgccatatcggttttgggttggccaattaggcgttgtaataacgacgcataaatcggtgcgccacccatcaaatcaaccacgacatacgcgactaacgataaaatcgccaacggcattaaatgggtgagtgtcccgaccatttcggttaccaataaaatcgccgtaaacggtgctttcccgatgccggcaaaataaccacccatcgcaaaaataattagattagggacataaaccggtgctaaccagcccaattggaccatcactaagccatagacggccccaattagtgcgcccagtgacaagatgggcaagaagatcccccctggcaagccagaaccatacgaaatcattgagaaaacaaaccgcaaaactagtaacaatgccaccgtggttaaagttggcacttgttggcctaattgtgtgatcaaaccattcccgccacctaagaccgttggccaaaagtaaccgatgggcaatacaagcactaacggcaataagccccaataatatttaggcactggtaatcgcttataaaactgcggtaaccaaagcaacgttttttgatagacgtagcccaacaacccgagcacaatccctaaaagaatcagatgccaatactgattaatcggtaaattatgtgtatacgtaatgtgcaacgtgggcgttaatccgaaaaaattcaatgagatgaagttggccccgattgcactggtcaatgcggttagccaaacaagtggggaaaaattatgatagatttcttccagtacgaaaaaggttccagcaattggtgcgttaaaagcggccgataaaccagccgccgccccaccagcgattaaaatacggcgatcagcgccgtgatcgtctaagcggtccgctacgccttgaccgactgccgcccctaattgaattgaggggccttcacgtcctaggaataagcctggcgcaatacttaaaataccaccaacaaatttgcgccaaagaatcgaccaccaagctagctcaaattcgccttctagttgcccttccacttggggaatccccgaaccactgatattaggttcttttttcaatagctgcgccacaaccaagcctattagcaagttagcaccgattatccacaaccagttaagtggttgactatgcaagctttgatacaacttaatcgttagtgctaagcctttttcaatcgcaagtcgaaacaaactgactactaagcctgtcacacccccgactaataacccttttaaaataaaaacaaagcgggttttattaaagcggctggcacgtctgattcgtccgttttccaaatgcaatctaaatcgaaacagcttcgttggtataatgttgcacttattgcctttgtagcggtttggggtcttggtaacgtggttaataactacgcgcaacaaggtctctccgttatcacgtcttggattctgatcatgctcttatatttcgttccttacgcattaatcgttggtcaattaggttctacttttaaagatgctaacggtggtgtttcttcctggattaaagcaacaagtactaagcggctcgcttactacgctgcttggacttactgggttgttcacattccatatcttgcgcaaaagccacaagggattctcatagcactcagctggcttttcaagggtaacggaaacttcgtcaatacgatttcatcaatggccgtttcggtcatctgtttggtccttttcttactcttcttatggctatcatcgcgcggaatcgcgaccttgaaccggattgggagtattgctgggaccgccatgtttgtgatgtcaattcttttcatcattctcgcagtttcagccccttttatgactaaaggcgctcacattgccacaccagacatgggcaatattaaaacatacatccctaagtttgatgttaactatttcacaaccatttcaatgttagtgtttgcggttggtggtgctgaaaagatttcaccttacgttaacaatactaaaaatgccgctaaagaattccctaaagggatgttagtcttagccggcatggtggccttttgtgccatcctaggctcatttgggatgggtatgttatttgattcaaaccatattccaactgatttaatggctaacggtgcttacgaagccttccatcgtctcggtgctttctaccacgttggaccactcttcgttatcctttatgccttagcaaatacactcgcacaaatctcagcgctagccttttcaattgatgccccacttaaaattttattgggcgacgctgatagtaacttcattcctaaaggtctttcaaaactcaacaaaaaaggcatcccaactaaaggttacatgttaactggggtcctcgttggtctcttgattatcgtgcctgccctagggattggtaacatgaacgaactttacaactggttattaaacttaaactcagttgtcatgccacttcgttacctctgggtattcttagcttatatcctcttaaataaacaacttaaaaaattcacgtcagaatatcactttactaagaaccctaaaatcggcttaatcgtcggtagttggtgcttcttcttcaccgccttcgcttgtttgatgggcatgattcctaagctttcatacgctgctaacccttcaacatggtggttccaattaagcttaaacatcatcacaccaatcatcttcattgcgctaggtatgatcttaccagcaatcgcaagaagacaaaaagcatagttaacttaatcttctatttttaaatcgttgccatggtcgctctgtataaagccaaccgataatcccgataatgacgatgttccgtaagatgacccacagtaagactattttttcatggttggctaatagttcataaggttggcggctgaaaacgccattcatcccaaacaaccaagccaaatataatgtgccgataacaaccagcggctttttaaagccagcaatttggaccaattggttcttattttcaagtgataagcgtttataaatccaagcgccaccccataacaatagacaagttactacgaacaaaccaatgattaatccaatttgttgttggttacgatacaaccggtattgaccattgcccattgttaatagcttagtgagtaagccaccattactatcaggattaacaccatactgttcacttcctcgactcattacaaaacgtcgcgtgtcactcatactagtaatagcgaaagagagtgaacaaataaaaccaaaactaccaattagtaaccctattaaacaaccgattgtaaaaattcctaacattaaaacaaggctgccaatctcacgttgaattagcgtcaggatatttagctgaacgtatggcgcaccaatttttaattttaaaattaaatagtagataacatctcctatcaacaggctacttaatactgttccgattccataacctaatttcgtccagtatagccgtcgccgcgaactctctaagctaaacaaaaacgtatcaaaattagtccgtcgatcattggcaaatgttaagagccctgcaccaaaaacaatcattattagcacgatcatcgttggtgaataaatcataaatcctgactcgtaagtctgttcaaatacaggattagcctctaatctaaaagcctctaatgattgtttcttgggatggcctttacgatcttcttgtagatatgactttggatgttgcttaaaatctttaataaactgttccgaatgataatattgatcagatgattgccatttatcaacaacagtcatacttctcatcccttgcaacccaacaataatcacaaacaagccgaccaagtacttccaatagcgtaattgcataattttcattaactgtttttgcatctaaacgaagacttgatagtcttgttcgttaattaagtttgcttcgaaaacatcctctaatgtaatcggtagtgcttcgcataaaacagggtccagtgcagccaactcctgttcaagcacatctgtatagtctgggaaataaacgaccatcacgcgccccgaaacatttaataaccgtcctttttcttttaccaattaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaattaatttctgttcggattaattatagaatttgccaccagttgtaacttacgtgctgtttggcggagtgtttctaaacgataatcgtgactaattgtccgatcctttaaaatcagtgtccggtcaatcaagggttctaattctgctaaattatgtgatgtaatcagcagtgaaaattgttgttcaccaacttgatcgagcaatagccgaatcacatttttacgaataatgacgtctaagccatcaaatggttcatccaacaaaatgtaacgtgcatgactactgatggctaaaataatattgaataagccccgcatcccttttgataattgccgataattttgtttaagcggtaagcgatattgcgctaataaagtagtcagctgattttcatcaaactgcggataggcttgttggtaaaaacggccaatctgtaataacgttaaatttttgaagaataagtgatcttcgtctaaataaaaaatttgtgtccgcaagcgacgatcttcatcgattgaaacgtgatcaatcaaaatctgaccaccatccaataaataatgaccggcaatactttttagcaatgtcgacttaccagcaccgttgcggccgaccaatcccaagatttcccccggttcttgttcaaaactaatctcttctagaattgatttttgatcaattcgtttatgtaacttgttaattgtcagcatttaattgtcagcatcttttggacccctttcaaattgtgcggttaaccattcactcatctcagcctctgaaacgtttaaataaacagcttctaaaacgagttcttgtaattgtgccttcagttgggcgattttaacattatcccggtcggtcgcttggtgttcagcgatgtaagtgccccggcctttaaccgtcactataatgccttgcacttctaacaatttataggccttgcttaccgtgttcgggttcatcattaattgccgcgccatttctcgaacagatggaatttgttcacccggttttaaaatcccctgaaggacttgttccttaatcaataaaataatctgttcgtagtacggtttagcgcttgttttatcaatcatcatttattcagattttatctttaaatgcgttgcaaaaaagtcggtaatcgtcgtcattaaggcgggttgcactaaatgacgctctccttggcccgtcataaacgtcacgttttgcgcatacgattgcccttttatttgtcgttcaaaatcagccatttgattataggggatccgttcatcctcggtaccatgccaaaataaaacggggcggttcgcaagtgcattcggttgttgggttaaatcatagggagttagccaactcgtcaacaagccaaaatcagccggttgttgtaagccatgctgacgaacattatcgcggaccaagcgcgcataggtcaatggggctggcgagcccataatgcaagccgccactttgatttctggatgcttcgtcaataaagccgccgttgtcatgccgcccattgagacaccgccaacgccaattaagtcgtctttaatcaggtgcagttgctgccaataatcgatgattaaactaaattccgctagattggtttggatgctctgccaaaaagtccatgacggaatttctgatactggctgcaaccgttcaccatgattaagcgcatctggtaatacaacgcgcatgccagcttgcgctaatttacgcgcctgtgtcaggaccaattccttggccgaacgccaaccatgataataaacaaccagtggtaatggttcatggcgtgcgttttctgccacaacttctaacaccggaatgcctttaatctgccgctttaatacaagtgccatttacatttcttttggtgcttggacgcctaataggtctagggctgtttctaagacgatgctgacactcttcactaatgatagacgagcgtttctttggtcgtcgtctgccaaaatcttagagttagcatagtatttgttaaatgcttttgctaaacgtaatgcgtatttagcgacgattgatggttcgtattctttacttgcgcgtgcaatcactgctgggaagttgcttaacatcttcaagacatcccaagcgttatcgtcagcaacgactaattgatcatctacaacgacttcttggttagcttttctcaaaatactttgcgcacgtgcatttgtatattgcacgtaaggacctgtttcaccttcaaaacgaaccacttcttctaagtcaaagtcgaagttgtctaaacgatcattcttcaaatcgtggaagataacagcgccaataccaacttgtttagcaacttcttcacggttaggtaaatctgggttcttcgcttcaatttgatcgccagctaatttaacagcatcgtttaaaacttcttccaaaagaatcacgcgaccactacgagttgataatttcttaccaccttgtgtaattaaaccaaatggaatatggtggatttcgtctgaccagtcgttacccatttcttttaaaacagccttcaattggttgaaatgttcccgttgttcgccaccaacgacgtacaatgattgtacgaagttataagtgtcatgacggtacattgcggctgccaaatcacgtgtcatataaagtgtggcaccatctgattttttaatcaaagcagggtttaagttataagctgttaagtcaacgatttcagcaccgcgactttcttgtagtaagccttttgattcgattgcttccacaacagcatccatcttatcattataaaaggcctcgccgttatatgaatcgaattcaacacccaacatgtcataaatcttttggaattccttcaatgattcacttctgaaccatgaccagagttgtgttgcttcttcatccccggcttctagcttccggaaccatgcgcgcgcttcgtcgtctaattctgggtgttccacgtcttcttgatggaacttaacgtaatatttcaaaaggtttgtgatagggtctttcttgacttcttcttcactcccccattttttgtaggccacgattaatttaccgaattgtgtgccccagtcacccaaatgattgattttgattgggttgaaaccaaccttcgtcaaaatcttagcaattgagtttccgataacagttgaacgtaaatgacccattgaaattggtttagcgatgttaggtgatgacatatcgattggcacgttaccaccatgacctaaatcactttcaccgtatttagcagcttctgttaaaacggtcttcaagatttggtcgctaaaagcagccttgtctaagaagaagttgatgtaagggccgttagcaatgactttttcaaagccagcaacgtccatttgatcgactaaatcttgggcgatttgttgtggtgccttccgtaatattttcgctaagataaatgttgggaatgcataatcacccaaatctgatgtcttaggtgtttcgatgagttgtgcgattttctctgctggtaaactgtcgcctaaaacgccagttaatgctgtgacaacttgttgtttaaaatccatttattcagctgctaaggcttcgattgggtctaatttagcggctttgcgtgatggggcaagtgctgcgagtaaactaatcaccacactgataacaatcccaaagatcacataaccactggtaattgccacaatcggcatgtgcgtcaatggttgggcaatcacgttaaccaatgcttgaccaccccaggcaattaaagcccctagaatacttgagaagaggccaatcaagaaagcctctgacatgaataagtgacgaatatcctttttacgtgcaccaatcgcccgtaaaataccgatttctttcgtccgttctgaaacactgatgtaaagaacgacgataatcatgattgctgaaactaataatgaaatccctgcaatcccagctaagacgtagaaggctaacttgaggtacgtattgattgaatctaagatcgcgccgacaccggtaatttgataatctttttgcgttttaccatctaccttactgtcataagctttgatcttattttgaaccgctttgacgttttgcgttttattcaccgtaacagcggcaaagttaggttctaattctaagttttgggcttgatacatctttgctaaagtcccataagtaacggcttcagtccccgaattgataatccctgagaccttcacatcttgacgcatttgaactggtcgttggtctttactaattgcgttgacgtatacagttaccgtgcgaccaaccatcttcttgtaatttttcttatctaattttttggcagttgccttcgttaaaagaacttcgttggcgcctggttttgtcccggttttaatatcttgaacccgttccgtcttattaaaggtttggaacatttggattgtttcactcttcttttggtagtgaacttggacaccatcggcataatagcccttttcaacctttgtcacatttttaatcttatcaaatcgtttaatgtctttatcggctaaatttccttggtcgccatcttcaatttgcttttggctcacattacgagcaatttgaatcgtattggggttcacttgagatgatacctgatcattgatgtacccggtcaccccttggcctaagcctaacattaaaatcactgagaaaatcccgatggaggcaccaaaaatgattaacaagttccgtttaatgtcatagcgcatatgttgcatcgccattttaaaagctgacatgaagctcaatggactattcttcttaggtgttgattcagctggtgctggataagcatccttgaggcgcttatcataatcgatttgaccatcaaccatgtggacaacgcgtgtgccgtaatctgcaacagcttgcgaatgagtcacagcaataacgagtttaccgtcttcggcaattttttgtaaaatcgccaagatttcagcggtattttggctatccaaagcacccgttggttcatcagcaataatcacatcaggatcagcagctaatgcgcgagcaatggcaacccgttgtttttggcccccagatagttggttcggatgcttattaatatgttccttcaaaccaacttgttctaataaggcagttgcctttgcaacccgttccttatgcgacaaatcggtcatttcaagtggtaccatgacgttttctaagttggttaagtgactaattaagttaaaactctggaagatgaagccaattgtctgactgcgataagcatcgaacttcttttcagaagcattcttcagtgattcgccatcaacaattaattcaccttcatattgatgatccaaaccaccaataatgttcagtaacgttgatttaccgccaccagattcccctaagatcgatacaaattcgccccgatcaaacttaagattaatgccttttaaaactttaaacgcttctttattcacatggtaggacttgtgaatatctttaatctctaataatgtcaaatgaaagattctcaagaaacatcacaagaactttcggaatcatcggcttttcattgtccagcgtgccaagcctctattgattacggtatcaaacgctgtccgagctgtcagactgccatcttttatcgtgatatgtctgaaactttttggaatgatcgcaagattaagatgttcaaacaaagcgacgcaattcaccacaatcactaaatgttagaaaagaacaaaatgagtttattcagcttagtcatgttaggactaagttcaatcatcggttccgggtggctatttggtgcttgggaagcaaccactgtcgcaggaccagctgccattatttcatggattgtcggtgcgattgtgattggtgccatcgcctttaactacgtcgaactggggaccatgtttcctgaaagtggtgggatgagtcattacgcgcagtacagtcatggctcattattaggttttatcgcgtcatggtctaattgggtgtcgttagtcacgattatccccattgaggctgtcgccgctgttcaatacatgagttcgtggccctggtcttgggccaactggacgaaccgtttcatgcatcataatgagatttcaacccgcggtttgttagtcgtttttgcttttatcattgtctttacccttttaaatttctggtcagttaaattcttgacccgtttcaccagtttcatcgccatttttaaattggcaattccattactaacaattatcatgttagtttcaactgggttccattctgaaaactttggccattcggtagcaacctttatgccatatggttctgctaaaatttttgcggcaacatcgatttccgggattattttctcctacaacgcctttcaaacggttattaatgttgggagcgaaattcgggattctaaacgcaatattggtcgcgggatcgcaatttcacttggtattagtatcgtcatctatttattacttcaaatcacctttatcggtgctgtttctcccgctttaatcgctaaaaccggttggcatggtttgaatttccaatcaccatttgccgatttagcaatcctattagggattcactggctcgccgtcctattgtacttagatgctttcatctcaccatttgggaccggcgtttcgtttgttgcatcatgtgcccgcacactggcggccttgaagcaaaacaaacatatgccaccgattgtcggtaagatgaaccaccaatataatatccccagagtcgccatggcgatcaacgccgtagtcagcatgttgttagtttccgtcttcagaagctggggcacgcttgccagcgttatttcgacggcgactctgattgcttacttgaccggtccggtaaccgtgatgtcacttcggaaaatggcgccggacatgaatcggcctgtccattcatcatggatgaaagtgatggcgcctttatcctttgtcctcgctagtcttgcgacttactgggcaatgtggcccacaactatcaaagttatcggcgtaattatgcttggcctaccattttatttctactatgaatatcggattcattgggaaaatacctgggcacaattcaaaggcagtctctggttgattatttatttagccttgctgtcattgatttccttccttggtagtcgtgagtttaacggtatcaacgtgattccttatccgcttgatttcgtcctaattagcgccttagccctcatcttctattattggggtattatcagtcgcttctactctaaatacttctcacgcgccaaacgaatcaataaggacgtccaactttaaatgaaaaaatttgccgtacaatcaaccgaccgtcagcaccaactccacgttgttgcttggttacctactcaaaaaccaatcgcagttgtccaaattctaaccggcatggccgaatatatcgaacgctatgacgcgctcgcccaattcttagctgatcgcgggatcgtcgtaattggccacgatcatgttggtcaaggacattccgttcagacaactgatgaactcggttattttggcccccatggcttacagacactattaaacgattgtaccttaatcgggcgcatcgcccatgaagaatatcctgaatgcccactatttgtattgggccattcaatgggttcgatgcttgccacccaatatgtcaaacaaacgactgtgccactggctggcgcaatttttatgggcgttattgacgttccagtcgtgctcaaacccgctttaccactcgttaatttaatcggagcccttgcgcctaaacaaccaggcaagcttttgaataatctagcttttggcgtttatcctaaacgctttgacgccaatcggccgttctcgtggctcagttataatcaggacaatgtagcggcttacgaaaatcatcccctttgtggctacgtattcagtaataacggttttgcgatgttattgacgctgacagaattaacgcgtcatgctgattggcaactggctttaaaagaacgcccagtactagtgctgagtggccaagacgatcctgccggcggttatgggcgccgcgcccgccatttagcgacacaatttaaaaagcacaccgtcactaacgccacggtgcgcattttgccacatacagctcatgaaattttacaagaaacaaatgcaattgaacagcaacaagcgatttatgattggttgcttacagcaatttctcaatctcctgcaacacgccataattctcgttagttacagcaatttctcaatctcctgcaacacgccataattctcgttagtatccgcgcggtaggtggcatattgcaacatatcatcatccgcattacccattaaataactgtatttaactgtttgaagcatttctttatcattatacgtatccccaaaggccatcatttcagccgttgaaatattgaaatgattagctaaaaagcgcatcgcgtggcctttatcaatccccttgttcatgatatcgacccattccacaccagcgacggccactgaatagtcagcaccaaacgttggcccgtaaatttgttcgtaaaagtcgcggctattggcttctgggaagtaaaccgtaaacttatccgcttcaacactcactttggttaaatcaggaacgtatttgatttcggcatagaattgacggaatgtcgcatctaaagcttggtattgttcttcaatataaaccgcatccattccacaaatcatcccgattccggtttggctctcgttcacaaaagcgaccatccgttgataatcagtcaatggcaataagctcttgaagataatctcaccttgataactgatgaccccgccattatcgcccacgaggcacatgtcattttctaacttagcaaacatctgcttcaacgtatagagtggccgaccactcgccgctgtgaaaatgatgcctttggccgttaactgtttaacaacttgttcaaaattcggtggcaactggccactttcgtttaataaggtatgatccatatctgatgcaattaatttaactgtcatttatgataattttaatcgttttagtcgtaaggcatttaataacaccgacactgaactaaaactcatcgccgccccagcaatcattgggtttaaaagtggtcccccaaacaagtgcaggacacccattgcgactggaatcccgagaatattataggcaaaagcccagaaaagattctctttgatattttgcatcgttttccgacttaacttaaaagccgttggaaccgccattaaatcatcgtgcatcaacacaatatcggctgattcaatcgccacatctgtccctgaaccgattgctaggccaacatcagcttgcgctaaagccggcgcatcattaatcccgtcaccaaccatcgccactaattgaccggttgcttgtaaggttttaatttgggctgccttttgttctggtaaaacatcactaatcacttgttcaatcccaacttggtgtgcaattgcttgagccgtcttttggttatccccagtcaacatcacaacttgaatccccatcttttgcaaacgactgatggccgcttgactcgttgctttaaccggatcggcaaccgcaattacgccttgtaattgaccgtcttgggccaagtacatcggtgttttgccttgttcggccaattgttgcgccgtcttcaaacctgcttcaattgcaacaccattttcagccattaattgttgatttccaaatagaattgtctggttcgcaacttgggcggatagaccgtaacccggaatggctgtgaaatcggtcattgctgataaggttaattgacgctcactagccgcttggctgattgcacttgctaatggatgttccgaaccagcttctacactggccgccaattgtaacaaatcgtcttcagtgccctgataaacaaccatatcagtcacgattggctgtccggcggtaatcgtccccgttttatccaatacaacggtttgaatatgttgcgccgtttcaagtgcgtcaccgctcttaatcaagacaccattttcagcccctttgccagtccccaccataatggccgtgggggtcgctaaccctaaggcacatggacaagcaatcactaaaactgaaatcgtaatcgttaacgcaaagagccacgattcttgtcctaaaaagaaccacgctaaaccggataataaggccaagccaatcacgattgggacaaagacgcccgcaatcttatccgctaaccgtgcgattggggccttagtcccttgcgcctgttcaaccaattggacaatttgtgctaaggccgtatctttaccaatcttagtggctttaaattggaaatgaccatttttatttaagctggccccaataacgacatcgccaacttgtttttcaacgggcaaactctcaccggtgattagcgattcatcaaccgccgaatgacccgcaatcaattctccgtcaactggtactttctcaccaggacggacaacaagcacgtcgccgacgaccacttcggccacatcaatcgttgtttcgacgctatcgcgtaaaaccgtcgcttgtttaggtgctaaattcaacaatttttcgattgctgacgatgtctgccccttagaacgcgcttcaaaatatttacccaacgtaatcaacgtcaaaataacactggctgattcataatagaggctcgtcactaagtcgatatgcccactgataatcgctaaggtggcgattaagctgtaaccccaagcagcactagtaccgagtgcaactaaggaatccatattgggatggccattgaataacgccttaaacccgacaatgaaaaattgccggccccaatatagcactggtaacgtcaatactagttgggtgaccgcaaagttaacgggcgcttgcatcggttgccaaaatgccggtagcggtaagccaaccatatgccccatcgataaatataaaagcggcaacgtcacaagggccgataaccaaaaacgccgccaaagcgcttgtaagtgagccgtgcgtttggcttgaatcgcctgcgcttctttttccggatcaatctgttctgttgcgccataacccgctgcgctcaccgcgtcttcaatcgcagtcacggataattcggaatcgtcatattcgacctgcattttttcggtggccaaattgaccgccgctttttgcatgcccggcaatttttgcgttgccccttcaatcgtttgtgcacaagaagcgcacaccatcccatcaatgttgaacgttttggttgtcatctagtcgaccgtgtagtgtgtgccttcaagtgccgctgccaaggtggcatgatcaatttcagtagccgtttggagcgttgcttgcttttgttctaaactcacttcaacggattgaacccctgcgatttttgagaagcgttcctgcacgttttgcgtacaaccatcacatttcatccctgtaattttaacgatttgtgtcatatgcaaattatcacagacgagttggcccgccaagtgatcgtggctcggcccgctattagtcacaaaggcgattttggtcgtattttaatcatcggtggcagtcagcaatatggcggtgcggctattatgagcgcctctgctgccgtttatgccggggcggggttggtttccgtggctagcgatttaagcgtccttgctagccttcacacccgtttacccgaagcaatgtttattgattaccggcaacccttcgtacaatgggcacctaccgttcaagccgccgatgtcatcgtaattggtccaggactcggcttaagtgcctttgcgttgcttcttttgaaacaggtcttgcaagctgttcagcctgaacaaaccctcttaatcgatggttctgcgcttaccttaatcgcccgcgaaaaacttgccctaccagatgcgcaactgattttaacgccccaccaaatggaatgggcgcgtctaagcggcctatcgattgaacaacaaactgtcgccaataatcaagcggcactggctgattatccaaaggcaactctcgtgctaaaaaaacaccacaccgaaatttatcaccaaacacaagtcagtcagctcatgattggcggacccgcaatggcgaccggtggtagtggcgatactttaactgggattatcgcggcgttctgtgcgcaatttggcccaactgctgatgtaattgatgccgcggtttatacccacagtgcaatctccgacgaacttgctacaactcaatacgtgacactgcccagtcagattattcaagcgttaccgcaatttatggcaaagatagctgatcattaaatgagacgtcttatattaccactattaacaaccgccatctacctgtttttaagctatttattggtcgtagttcggccaattcaaggtagccttagaaacattctaatcattgcactagtggctagctatgtttttgggacccgttggctattaaaagatgcctatccaatcatcccacaaaagtacctagtactaataaaaatcggcttgccaattgcgattatattaccattcataataatgattctatttcttttttaactattcttttaataatgctatttcggtagtttttaatgcgcgatacgcgccacgtttcaggtcagccggcaatcttaacggtcccatctgaagtcgctctagtgtcagtacttctttgtcaaccgcatggaacatacgcttaacctgatggaacttgccttcatgaatttcaacttcgatcaaactttcttggcgctttgtatcagtccttaaaatcgtcaattgtgctggttgggcatcaaaatcacgcaactttagaccggcagcaaattgtgcttgatcagacgctgttaccaccccggcaattttggcgcggtacgtttttgtgacgtgttttttcggactcaataaatcgtgggctaagtcgccatcattggtaatcaacaatagccccgtcgtatccttatccaagcgacccaccgggaataagtcttcccgataatccgctggtgcgaataaatccatgaccgttttttgcggatcggtcgtggccgaaataacccccgccggtttatttaataaccaataaaaattagtttgatagcgaatcggttcatcatcaacgtaaaccaccgtttctggggtcacttgatattttgcttctttgataactttatcggcaacacgaacccgccctgcctttaataatggcttgagtgttttacgcgtgccgacattcatatgacttaaaaaacgatcaattctcattcattttaatttcaactttcttctaaagcggtctaagttactgcctaagacataatcggctaagcgtgatttcaacgctaaagcagcatagactaatccaccaactgcgacactaatcgcaaggacgagcacactttgaagtcgactttgtggattaaatactaacaataatcctttaaccgttagtgatgtcatcagatacataatcactgagaagccgacgatcccgactaatcggcgaatcgtttgccaagcatcaaaatggtaatagcggtgtaatgcggctaacatcaagattgaactcgtcgcaaaggctaagcctgttgacacgagcggaccgtatacccggaagaaataaatggctgggtattgggccacaattttaacgatgaacccaatcaatagatagaacaaggccaaccgattttggtataacccttgtagaatcgcgcctaagaccgtgaaaaggcctaggagaattgaaatatacgatgaaaattgtaagacactaatccctaaggcatcgtgtgaatagaacaacgtataaagtggttcggccacggctgccatcccgaaggccgctggaatcatgactaaattaaaaagttgaatggtactcccaatttgttggcgtaattctttttgattaccacgaacatgagccgcagacatcaatggcaccgccgtaacagccattgcggccgctaatgaaacggtgattgaaatcagcttattcgcattaaccgcaaaaagcgtatatagattccaaagttggtgatccgaagcaattacaaaatcactcatcatacgattaaaactatactggtcaataatatagactaaattaatactagcatcaataacgataaaaggaatcgattgcttgataatccccttcaataaatcattcgttgaaacagttatcgcattattactaccagcaattaacttttcaatccgtggtcgctgctttaagtagtgccaaatcagtagaagtagaccagcaaccgctccgataaatgccgcaaaagttgcctgagtcacagcatcaatgtaacttcctcttaagacctgtgtgataacaaaaacagtcacagtcatataaattacccgagcaacttgttcaataaattgagaaatcgcggaaggtgccatctcagcatacccttggaaaaaaccacgcataatacttaagagtggaatcaccaacaatggccaacaaagtgaatggaacaccggaatcattctggcatccccttgggataataccggtgctagaagatataacgcacctgccgataaaatccccataatcagcattaaaattagtgatttttgaaagagtttctgcccaactccatattcattcatttcgttatagtgcgcaatttgttttgagagtgcccccggaatcccagcagtcgagacaacgattagcacactataaatttggtatcctcggccaaataaattattggctgctaaaaagttaaccccaaaccagattggccatggaataacatagatggctcccagaattcgcgagaaaatacttccggcagtcatccaagcggatccccgcaacatcttgctctgtgaagatttatccgtcgcctttgtatcagatgaattggtcatttatttcgttttcgttgtttgtttaatcaagtaccatgttaataagatactgatgaacaccatgatgctcccgaaaattggtgtactacccaagccccaagcggcagaagcttgaccgccgaccaatgagccaatcgtaatcccaatgttaaaggctgagatattcaaagccgatgccaatggaatatcgtttggtgtgaacttttcagcaagttggacaatgtaaagttgcaaaccaggaacgttcatgaaggcgaaaaagcccatcaataagacgttaattaaaccaaaccaatgtgaattcaatgttagcatgaataacatgagggttactaataacccaacaaacattctcaataatgccaacaaaggtttgtggttagaccacttaccgcctaacgtgttccctacggcaaccattaagccataaacaactaagataataaccaccgcacttggtgaccaacccatcttcgtttgtaagattggtgttacgaaagtataaactgtgaatgtgccaccataaccaagggctgtaattaataaggcaatcacgattgctttatttttgaagacccgaataatcccactaaattggcttggttgacccaatggtaagtcgtttggaaccaagaaccagttagcgattaagcccaagacaccaatgccagcgatgaaaataaatgacatgtgccaggttgaaatttgaccgataaaagtccccagcggtaccccggtaacagttgcgactgttaaaccagtgaacatcacggcaatcgcacttgctcggcgttctggttccacaacatccgccgcaatcactgatgcgattgacataaagatcccatgtgataacgctgaaataatccgaccgattaaaacaactgagaatactggggcaaaggccaccgttaagttaccaatgataaagacgatcataatccccaacaataaattcttccgtggccaacgactggttaagatagccaaaatgggcgcaccaatcgtaatccccaaggcgtacattgaaacggttaagccggcttggctcattgtaatcccaaaatctttaatcatcaacggcattaagccaacactgatgaattctgttgaaccaatcgcaaaggcactaatcgccaatgctaacaaagttaagttcgcacgttgctttttactcatatgaatgagaaaacttataacattggtgttgaagccacgatggaaatcatcggtggtaaatggaaacctgtcattttatgccacttacggaatcaaccactccgctcaagtgaactcttacaaaatatccctaagatctctcaaaaagttttaacgcaacaattgcgcgaactcgaagccgacgggattatcaatcggaaaatctatcaagaaattccgccgcgggttgaatacagcctctctgaatacggtcaatcactcaataagattttgaacctactctgcttatggggtgaagataatatcgaccgccgccaatcagatggcgaatcgatcaatatcttgcatcgtgatcaaattaatccaatctactaactattctttttgacgtccaaacttcacgaaataaataacgatcatcaagactaaaaagattaatccgacaattaatgagatccgtgtttctggattaataaacatgaaaactaatgttaagcacaacatcgccaacgtgatgtagttggaatatggtgaccatggcattttaaatggatgggttgccatcttttcggcgtgttgttttctaaaggcaatttggctaattaagatgacaaaccaaggcaccattcctggcaagacacttgaactataaacaaggacgaagatattgccagctttaggataaaccaatggtagaatcgcgtttaaaatcacaccaattaaaatccctaatgaaatcgcaccaaccgcataaaatggcacgccatgtcggttgagtttcaagaagcgttttggtaattgcccattattagccaacgtaaacgtcattcgactcgcactgtaaatcccagagttagcgcctgataaggccgctgtaatcacaacgaaattaataattgaggctgcggcggtaatcccgattttagcaaaggtttggacaaatggtgaacccacttggttgagttcgttccaagggtaaatacttaaaatgacgaaaatagcaccgatgtagaaaatgaggatccgagcaacagttgattgaatcgctttaactaatgtttcttgtgggttttcggcttccccggccgtaatcccaattaattcaatcccttgataagaagcaaggacaatcgcaagggcaaagacaaagcctttgaatccacccgtgaagaagccgtgtgtccataaattactaatcccaaccggatgcatgtgatttccaatcccgaagatgattaatccgagaccagcgacaatcattaacacaatcgtcaccactttaattagggcaaaccagaattctaattcaccaaacatgctgaccgatatgagattagcggcacataagaacgtaattgcgactaaacctggaacccaccctggcagattcggccaccaaaattctagatagccaccgattgcaatcatttcactcatcccaacgaccacaaattggaaaacattactccaagctgtcaaataaccaaaaatggggtgcatatattccgttgcaaatttcgcaaacgatcccgtatctggatcaacgtacaacatttcccccaaagcgcgcatgattaagtacaataatagaccggcaatgccataagcgattaagacagaaggccctgtccatttaatcgtcgtattggcccccataaacaaaccgaccccgattgtcccacctaatgcaatcatctgcatctgacgggcatttaaattccgtttcatctaattcgctacaatatttaccaatttgtttggaatggcaatcactttacggactgtcttatctgcgataaattcggctactttttcgttggcctttgccatcgcttctaattcttccttcggtgtgtctttagccactgttactttggcctttaacttaccgttaacttggaagatgacttccacttcattagcaatcaatgctgctgggtcaaatgttggccaatcaacatagctgattgaatcatcatgaccaagcattgcccataattcttccatcatatgtggtgcgattggggctaataatttcacgaagccttcagcatattcacgtgggaatgtatctgctttataagcatcgttgatgaaaaccatcaattgtgaaatggccacgttaaagtgcatgctttcgaagtcttctgtgactttcttaacggtttcgttgtaaaccttcttcaattgatcgttgttgtcagcgacaatcttgcttgaaagttggtcgttttcgtccgtatcttcttctgtgtataaacgccatacacggtccaagaatttacgagcgccagctaagcccttttcactccatgaaattgaagcatctaatggacccatgaacatttcgtatagacgtaatgtatcagcaccaaaacgatcaacaacatcatcagggttaacaacgttcccttttgatttagacattttttcgtggttatcgcctaaaatcatcccttgattgtatagatgttggaatggttccttcgttgggacgacaccgatatcatacaagaatttgtgccagaaacgaacatatagtaaatgaagaacagcatgttctgcaccaccgatgtacatgtcaactggtaaccagtccttcaacttgtcaaagtcagccaatttatcagggttcttaggatcgatataacggaggtaataccatgaactaccagcccattgtggcattgtattcgtttcacgacggcctttacgaccattttcgtccgtcacgtttaaccagtctgttaagttcgcaagtggactttcaccagtaccagaaggtttgatatcgcttgttaatggtaattcaagtggcaattgatcttctggaacgacagatgttgtgccatcttcccaatgaataattggaattggttcaccccagtagcgttgacgtgagaataaccagtcacgtaatttataactgatttgttcatgacccactttgtgttcaaccaaccatggaatcatcttgtcgatagcagcttgtttgtctaagccatctaaaaaatctgaattaatcattacaccaggttctgtgtgaacagcttcttcagggttaccgcctgaaacaactggtttcaatggtaaaccgaatttcttggcaaattcccaatcgcgagggtcatgtgcaggaacggccatgacagcaccagtcccgtatgaagctaaaacgtaatctgaaatccagattggtaaacgttcgccgttcactggattgatggcataagcacccgtaaaggcacctgttttgtccttagccaaatcagtccgttcaagatcactcttgtgttcgatttcttttaagtatgcatcaacggcagctttttgttcaggcgttgtgatgtcagccactaatttgtgttctggggccatcacgatgtaactaacaccaaacattgtgtcggcacgtgttgtgaagacgtcaatattagcgtcatggttttcaacagaaaatgaaacttcagcaccttttgagcggccaatccagttacgttgcatatccttgacactttcaggccaatcaacaaggtctaagtcgtcaattaaacgatcagcataagccgtaatcttcaacatccattgacgcattggtttccggtaaacaggataaccaccacgttcagttttaccgtcgatcacttcttcgttggccacaactgtccctaaatctgggctccaattaacagcaacttcggcttcataagccaagcctttttcgtacattttttcaaaaatccattgggtccatttgtagaaatcaggatccgttgtattcacttcgcgatcccaatcatatgagaagcctaatgaattgatttgacgtttaaaagtgttgatatttttttgcgtgaaatcagcagggttattccccgtatctaacgcatattgttcagcaggtaagccgaatgcatcccaacccattgggtgcaacacgttgaagccttgcatccgtttcatccgggccaagatatcagttgccgtatagccttcaggatggccaacgtgcaacccttgtcctgatgggtatgggaacatatctaatgcgtagaaatttttcttatctttatcttctgttgttttaaaagatttatgtgattgccagtaggcttgccacttttgttcaactgcgcgatgatcgtaagtcatttacttcaatttcaagacttggccaactaagattaaatctgagcgtaaattattggcagtcttcaattggctaattgtcgtgccatttttttgagcgattgaccataggctatcacctgatttaacggtataagactttgttttattaggcgttgtttggttgttattgttagttgttgttttaccagcactgacttttaacacttgacctggataaataaaattatttttaatgttatttaaacgaaccaattcagccattgagattcctgattgttgtgaaatccgccatactgaatcaccagctttgaccttgtaggttttagcggttgtcgttgttgagccattgttattattactactgctattgttgttgttatttgttggcggtgttgtttgtcccgttgatttttgaccaacaattaatttttgaccaggatagatgaagttattacggatattattccacttcactaagttcgccattgaaacaccatagcggtttgagattgcccaaactgaatcgccagacttaaccgtgtaagtttggttattcgccggtgttgttgggttcgttggatttgtcggtttagttggattcgttggtgttgttgggtttgttgtttgtttagcagaaacaatcaaaacatcgcccgggtggatcatgttatttttaatgttattccagctaattaacgtattcattgaaataccgtaacgcttagcaatgccgtaaactgaatcgccggctttaactgtgtatttttcaccatttgctggttttgtcggattcgttggtgttgttggtttgttagccgaaacgattaagacatcaccaggatgaatcatattatttttaatgttattccagctaattaaagtacttattgaaatcccataacgtttagcgatgccgtaaactgaatcgccagctttaaccgtatacttttcaccattcgttggtttagttggtgttgttgggttcgttggtgttgtgcccgtaccaccattattaccacttgtagcaggtgtatcatattgcgttaagttatattgttggataaggcgatttaaactagctgcatagttcgtagctgtggcatagcgaccttgaagatattgcgtcgcattttgatagcttgttgtgtggctcttgaaggccccttgataataaggtgttgacccaaaagaagtattcttcaaaacatgcacgtaatcttgtagtgattggtaatatgaaggatatttacggaaagcagcgttgatttgataaagattaccatgaccatcatcttcgtttgttaacatgtagacagagctaccgttgtaactccctttaacaccgaataagttgtagttaggggctttgcctaaagcgctattcccaaaacctgattcaagagaagcttgggcaatcattactgaagcatacaaatcattttcacttgctaattgacgtgctgagctagcaattgaattgatgaaagttgatgcactggttgatgaataagccataatggcttgggctgttgcgatattagcacccgtattttgtgtgccaacaactggttgtgcttgtgttggtttgggttgagctgtagctgccttattcgcatcattttcagtcacttgaggcttcacaactggttgtgattggctttggctactacttgttgtttggcttgattgactttgactgctgcttgttgcttggtcagtactacttgttgaggtcgtactattagcaacactacttgtgcttgatgtcgctgtattgaggttggtttcgttggcactcactgtttcaacagctgccttaactttaccgctcgtgagactaggtgcaaccgcagaccccatcaagaaactagctcctgcaaaagtcgtcatatgccgcactttcttattccgtagttcctttttttgacggtttaaaattattttttgtgtcgcgattctttgttttctagtctctttcaacatatgtctcgtcaaaagcaacaactcacatcaatgatagtgggcttttcactatttatgattattttagtcagtcttttaaaccaagcaacttggattaatactttcgatagtcacatcattcatatcgttcgtagcgttgcctcacctttaacaaccactatagcaatcgctatcacaagcataggtaatccttatagtatgctgggattaacagtcgtagcaacgctcaccttactcttcatccgccagaataatgctgcgctcttcttattagtcaatatggcggttttcagtagtttaaaccacattattaaagaatgggttgctcgaccccgacctagcgcgcatcatttggtagtcgctagcggctttagttttcctagtggtcattcttctggtgccctattattttttggctcattaagcattattgccatttacctgattaaaagtcactattggcggcacctagtaattggtttgtgcttaatactgacgctcctcattgggattagccggatttacgtgcaggttcactaccccacagatgttttagccggtttcatgttagccttaaccggattaggcctttcgtggtattattttgatagctaccacctattgcagcaaaaatcgtaaatgctacttgatcagccaagttcttttgcccacttcctattagaccaggccattcgcccaggcgatgttgtcatcgacgccactgttggctatggcgacgatactttatttctagcggaaaaagttgccgattacggccatgtttatggcttcgatattcaaaaagaagcgttggcaacttgtcaaaaacggttaacaacggccaatcttaaccagcaggtatccctcatcaatcaaggccacgagcgaatcattactgctcttcccgccgatttaaaggtgcaagcggccatcttcagtcttggctcactttcatcagagacttctcaagatgtcacgctccctaacacgaccatctcggcttaccatcaagtcttatcccgtctcaatcggggcggtttattactttttatcattgataatcacttttttaaatcagaagaagaaatccactacttagttgcagatttaacccgcctcaatcctgagcgttatgcagttcgccactttcaaggcgtcaaccaagatgtcggtcaactactgaccgtgatcaaaaaataattaaccaacgattttagtgccatgtgcttctgtcacgtttaatcgttcagtaataccagcaacgttttccgctgtaatgccaccgcctggtaaaatgcctaagcgaccgtcagctaaacgcactagttcttgaagacgttcttcatttaacggtgccgttaatgggccaccatgcgttaaaatccgtttaacatcatgttcaaccaaccagtcgattgcttcggcttggtcagctactgctaattcgtcaaaagccatgtggaaaacaacttgcatcccattggcagcgccaattagcatttccattgcttcatcatcaatcttattgtcaggtgttaagcaacccacaacaatcccgtcagcgcctaattcttgtgctgaaaaaatatcagcttccataatttttaattcttgatcgttgtagacaaagttaccaccacgggggcgaatcatgaccatcactggcacatcatgttcatgtgcataacgtactgattcagccataacaccacgactaacagtggtgccgccaaccgctaagttgtcgtttaattcaattcgtttggcaccattacgaatggcagccggaatttcggtgaaattttcgacacaaacttctttgattaacatttataagaacattgcgcctaataccaatacccctaggataatccgataccaaccgaaaaccttgaagtcgtttttcttgatgtaacccatcaagaacttgattgaaatgattgaaatgatgaatgagacgaccatcccgaccaataaaataattgattgatcaccagtaaaggtattgccttggtagaagaacttcccaatcttcaagatgctgaccccaatcattgttggaattgccatgaagaatgagaattcagccccaacaaaacgtgatgtcccaattaaaatcgcccctaaaatcgttgcgcctgaacgtgatgtcccaggaataattgataaggcttggaaacacccaatccaaaaggcggttaaccaaggtaacgtatttaaatctgcaaatttgggtgtgcgttgtttattgcgattttcaataacgataaataaaataccatataaaattaacatacttgcgacaacccagttttgcattaaatgttcgtccatccaatcattcaatgggaaaccaataatcactgacggaataaccgccaaaataaccttaaaccataaagtccatgtttgcttttgctctaattgattcttctgcggtgaaaatgggttcaatttatggaagtataagacgacaacggccaaaatcgcaccgaattgaatgacgtaattaaacatatccataaaggcttttgattcgcccatttttaaaacactacctactaatactaaatggcccgttgaactaatcggtaaccattccgtaaaaccttcgacaatccctaaaataattgccttaatcacatttaaagttaacacttagagtgttgtttcatcaaaatcaaactggcgttgcgctaaaacagcactaaaatcagctggcaccgggcttttcaccgtaattgttcgttcttcaaatggatgatagaacgtcaattggcggcaatgaagtgcttggcgcggcaataaatcatcagattcaccgtagaggttatcaccaattagcgaatgccctagcgatgcaaaatggacccgaatctgatgtgtccggcctgttagtaacttcaatttaacgagtgtggcgccatcaccgtgagcggcttgccaatattcggtcaatgaccgcttaccaccttcgccgaccacccgtcgcatgtagaattcttccgagcgtttaatcggacgatcaatccacgcatgttgcggtaaatcctcgcgcatatcaccactagcaattgcgatatacgttttttgcaattctttcgactgtaattgccgatccaacaaactgtgcgcaaatccatgcttggtaaacatcatcaaaccactggtatcgcggtccaaacgcgtgacgacatggactgcgaggctttcagcttgttcatcaattaaatactgcttcacaaaattggccatcgtattattcggatggttgggagccggtagcgaagcgacaaaggctggtttatcaacaatcagaaaatgatcatcctcataggcaatttttaaatcacccttcacaggaatcacgtgttccaccgcaacttctggcgctagataaaccgtcaccacatcattttgaactagtctaatattggtatgggcttcctgaccattcactaaaatctgcccacctgagaatttaatcttcgatagctgactccgagaaatctcatgtcgtcttaaaaaattacgtaaaatgcagccttcgctgtctgtgtattgccactcaaatttcatgttttgacccaataaatgcattcaaatttcatgttttgacccaataaatgcatcttcgacgcgatcccagaaatgggtgtgtcggtaacgtgcaaattgtattctttcttttgcaattttaaattgcattgattcaattggtcgatccttaaacgtaaactgatcaatcgtcacaacgtaatcgctggtccgtgaaggttttaaaagtaaccactcatcagaaggcaacacaattggtgcggccagtgttcggtaaacacgattattaatcgacgcaatttcagtcaattgcattgcttctaagcgtggatgcaagaccgccccaccaattgattttccgtaagccgttgagccagttggtgtcgaaacacataggccatcaccacggaaactttcaaaaaagttttctttgatataaacatcagtccgcaaggttgccgcataacgccgcaacgtcacttcgttcaacgccaagaagtgttgcacttcattggtatcggcataggtaatcttaacctcgagtaacggataactaatactctgacccaaatcttcttgtaaagcgactactaaatcatcaacttcaaaatcccgccaatccgtataaaagcccaggtgtcctgtatgaaccccgataaagcggatttgatctagcgcatcagcatagcggtgaaaagcagatagtaacgtcccatcgccacccactgaaatcaccacttctggtgtttgtgcgtccatcgtaaaaccgttgttaattaacttattggttagtttatcagccacttgtcgagaagagctgccgtcattgctatataccgttattctcaatcaatctggggcatctccttcagaatcgttttcagtcgccttttctaaagcactctgccacttaccgtatgaaaagagctgttgtgcttcttgaatttcttcgcgaatttcagacatttctttatctaacataaatgacgcttcggctgcccgttttaaacgtgccttcaatgtttcagggaattccccttggtatttataattgagtgaatgttcgatcgttgcccaaaaattcatcgacattgtccgaatctgaatttctgccaagattaatttttcaccgctgatcagttgcactgggtattcaaccacaatgtgatatgagcgataaccactgggtttaacgtttgaaacgtagtcgcgttcctcgataatcttcatatcggttcgttggtgtaataagcccacaatttcgtggatatcttctacgaactgacacataatccgtaacccagcgatatcttgcatatcttgttccaataaatcctctgtgatataccgtcgctgcattttttctttgatactatctatcggtttgacccggcccgttacaaattcgattggggcatgttcattattttgttgatattgtttacgcataccacgtaattttattttcaattcactaacggcttgttcataaggcatcaggaattttttccaattttcgaccatatgacacagaccattgaacatgaatttaaagtcagtctcactgaacaacaattcaatcaactgcgggccgcctattcatggccgacaccttttacccagaccaattattactacgagctaccgcaaaatggtttgtatcagcaacatatggggttgcgcactcgcctctaccaagaacaggcagaacagaccttaaaagtaccccagactggtgcgacacgcaccctactggaaatcaccgatacaatgccattagccactgcacagcaattgattgcgcaacaaaccattcagcccgatcagcaaattgctaagtatctagaaacaatcgggattgattgggcatcccttttcatctggggtcaagcaaccactaagcgtcaggttttaacactgcctagtggtcgcctaacattagatcaaacaacctatccggatcagacagctgactatgaattggaactggaatttgacgatatgccactcgcccaacctttcttccaagacatcgttgcgcgtttcaaattaacacaaactgcaccactcaacaagattcaacgtgctaaaaatcatcaaagctaaatgaacatccatttcaagttcatacccgtcctcaacttacaaaacgttgaacgttacatgcaatttcaaaatttaaaccgacgtgacttagacttaagaaaccacgtcttcagtacgatgtacgaagcagtcttagcttataaagcagcgactttccaaggaagtaagaagagccaagcatttttaatgcagctccaacaagtttttcaacaacctgatactacccttgatactaaattagttttagaaatcgctgaaaaggcccacttagatactgaaatgttactcgaagattggcacagcgatttaactaaacaggtttttgattccgatcaacaactagcctgtgaaatgaacattaagatgacaccttccgcagttgcctttgactattctaaagatgactctgaagccggcttattaattgaaaattgtgattcttacgacctcttgaaagaggtttgttctcagggagtgagtcctgaagacacgtaccaaaaattacaaaaacataaagctaatgtgactaaaatcgcctttcgcgtactgtcgtaattattttttagcccgcaaagcctgttgtagcctgcaggttggccaatctcgaaaagcttgttggccaattaacggttgatttaaggtgggacaaaactgcgaaaatgtggttacgggttgctcagccagccaccactttaagcgactttcaaactgattctgctgataaagtggtggcactaccgattgataaaaacaccaatcaggggctttttggagtaacgttccttgttggtaacaaatctgttgcaagcggacaaaacgctcatcacgtagctttagtcgttgcatcagccgcgctcgttgccaatcaatcggcatattttgaatattgattggttttaacaaacgatttttacttaaaaatgcgactagttgacgcggtttaaagtattgtgtccgccactgataaccttgaaattcaagcgcaacgacgtgatgttgcaagacccaacggtgcaattgcgtgctgtaacaaaatagataaaagccccatgccgggcaataatttaaaaaagccaattgttgccgactaagatgacgggatttaaaacggaaccgatcaccaactatccaagtgaccgccaaaccacttgcatgatacccctgcgttcgttttaacaatcgtgtgggcgtcaacggactacattgatactcaatcacttgtgactcacaattgagctttgttaaatagacatcggccctctgctcaggattaacaaccaactcaaaatccgcctgccaccccagcgcattagcaagtgctgcaatcgccaccttaccagtttgatgggcgtcactttcaccgccaccacccaccactttagtttgatgcgcaaaataaggaacagtctgctgaccgcccttgagctgaacaggcttttggcaccgcgggcaaaaatactgaccacttccaagtaagacggcatctccagcagacaccaactgaccagcaagattcaaagccattttcatcaaaacaccccaagaaaaaatacgcaaaaaagccagttgattattcatttaatctttaaaatagtaacgtgttaattccaaggcactattttccattactctctgaccatattcacttaagaaatcagcggtgtaatttgtcttatgaccaaattcattagcgaccgctaaatcatcttggacaaacgtttccgttgtattttctaagaagaacactaattgcgcgtaatattgatgtttgtaaacaaaaaggtttgaaacaccactttcaatgtgcaactgttgggcgagtgcaatccaatcttcaaatgtatcaaagcctaaaacaacttgtttagttgggttatccgcttgatttaaataagattcgatttcgtcgtcttcttcgtcatcctcagaagaggccgtatcccgcttcaatagttgatccttaatatactctctaataccgtcttttccctgaaccatttctgattgtgctttgttcaaatcgagattagataaattcttactaattaataactctaacccctgttcattaggtaacacttggaaagtgaccgcatcattattagcgaaaacgtgatcttgatcaacttcttctagaattgaatagaagaagcgctcgatttttttatgattactcaataaatcaagaccagtaatgccacgttcttctagatcatcattttccaataaaacacgaattgtgttttcatcgattttttccattctcatttagaatcctgccattaattgtgcttgttgtaattctagtgcgcgcacttcgcgtggtaagaaacgacgaatttcatcttcgttgtaaccaacttgaagtcgtttttcatccaagataattggtcgtcttaatagaccaggattttcttgaacaagatctaataattcattaacagataaatcatcaattttaatatttagttgttggaaaatcttagaacgtgttgaaataatttcttcagtgccgtcctcagtcattcgcaaaatggttttaatttcatttttattgagaggctccgaaaaaatattgcgttctttaaatggaatgttatgttcctttaaccacgcacgagctttacgacaagatgtacaacttggtgaagtatataatgtaaccatatgtctctctcctttaccttttatgagagcggctatgaaataacccatctagtctattttaattgtcaaaccctgttcggcaattgtgactggaattgtcgttatcactgttttagcttgtgccaataaagtctctggtgtgacagcttgtggtaaatgcgttagcaataattgtttaacgccgctaatctgtgcaaggttcgctgattgcgtcgtcgtcatgtgcgccatcttccctgtacgatcagccaagaagttagtgtcagtcatcaataaatcagcaccctgacagaactcagctaaccctgggaagtaggcagtatctgctgtaaagactaaaaccttgccggttgtttcttcttcaattcgaacggcaaaggctggtactggatgttcagtccgcttaaacgtgactttcaatggtccgagttgcaacgtagtatcttcttgataaccaaaaccttgcgttacatttggtagggttaggctaccaaagtgcaatggatcttgtaaatgcccataaattggcaatatgggttctttcttttgacctgcttgtagttgccagtaatattgtaaaacgccgacatctgcgatgtgatcatggtgataatgcgtcaacaagacggcatctaattggagtggatcaagttctttttcgagtgccaagagtgcgccgctcccgcaatcgagtaataaatgataatcgccactcgttaagagataactacttgtgccgacccccgcgtatggataaccgccataataacctaaaactgttaattccatctattgaataatttgaatgcgttgttgcttaatatcttggtaaaaggccgtcacactgacgattaaatatggatagaaccagatgaaaccgatgccggccgtcaagtagactaacaattcccagccaatgaatgataaccctaatcctaataatttcaaccagtgcccttttaagataagtactgacaaggatagtagcatccgcattgaaacctgtggaaaatcaaatttgatcaacactaagatttgatagtacatcaaaattaatggttgcaagaaggtgattgctagaatcaccaacaagaatgccaaaacagtcgtatattgttttggattctgactaatctgcataatataaggtgccattgatgtgatgccattatacgtataacggaaaacccgttgccagctgattaactggtgaaatggtgctaaaccaataaatgttaatgcccaatttaataattgttgaatgaagtttaagataatcagatgcgtataaaacggtggtcggaacaatactaatgtatcgctgagacgcgtttcttttttgattgttaatttatacgccgctaagaaaacagcgtttaaaaagacaaaataaaataaatagttggcaaacgtatttaacatttgataaccaaatgaatttgtcttgaataagctttgcaacagcgtatcggtccccatttcgactaatagccagataatcactaaggttgccatcatctgccagtggccttttaatagttgccgcgcagttgcacgataagttcttaattgcaattaatatagtgcatcgtcgtttaacggtatattgacgatgcgattgtagatttcggcagttaccagatagaacacaaaataaatcataatgaaaatgccgcacacaatatagactaattgtaacccaggattatccaaaaacaaactcaataatcgaatcgcaaaaatcgcgtgcaaggtccccagaataatcggcaataaaaagataatcagaatttggaaataaatcgtgcgtttgatttccgaataagtcatgccaattcgttttaaggttttatactgcaaaatttcttcttgggcttctgataattgcttcagcatgatgatgctcccagttgccagcatgaacgtcaatgcgataaataaggcgatgtacatataaaagccaaagttggcattcgaccgatcttgattgggtttgcgtaataataaatcagcacggacaaaaccacttcgttcttctttagtcgtcactcgatagcgtttaaagccattctcatttctaacagctgttagatagctccgttttttcgtatcttgtgaaagcttaaaaaacgacttcatcagttttttatcgcgtcgttgcttaggcgttagatcaagcgcatagacatggtcaatagtagccggcttgatttgatcgtaatattgatctggcacagcaaccatattcagtgagccgtaaaaattaaccgatacgccatttggaaataaccgccgaagatgaataatgcggagctgtggtaactccggttgcttaatctgcagaggaattccttgttgattggcatgcgctaaccgtttatgatgtggcatcttaatcatcgttagcggtaaatcaatcatcgcaatcgcctcattaggccgtaatggcgttgctggaagcttaaattgtcgagccatcaacgcattatatcgcgataatggtaaaacgccagtagcaccagcaagcgtcatttaacaagggcgttgccagttcaaattgggcatcgacaattttataggtagtctctgtgattttttcggtgtaacctgatgcgcccgtaaaatttgttcgacaccttttttttgatatttagaataaataatatctgcgggaatattttcacgcaatgtcttttggctaaatgtatagatcatcgctgcgctccccaacgctgtaatcgtcacagcgcttagaatggtaatcatccacaatgttttcgcatttttcttaaaccgatagctcagattcgtcacactcaataaatgtgtgccccgataatagagtcgtttccaatggcgttcaattcggagccaaatctgcgtatacgcttggaaaaaggcaagtgtcccgatgacttcaaaccacaaaatggcacccaaataccccgcatcaataccatagccataacgccgttcaagttcgggcatcagcactaaaatacgttccgctaaataataaccactgataatcaaaacaatgccaattattccccagatggttgttaaccaattagggcgccgtattttgcggctaaattcggtagggtgtaataaatcgaccagttgatagcgaaaaattaaactactatttaataggccagttaataagaacagcaaaccgaaagtaatcgtcgtctgcttaatagctccccaggagattaaaaacgggattgcgacactgatgcccatcatccgtaatagtaacatcccaaataactttgataaaaagattccgaaaaacagaccaatcaacagtgcaatcgttccgattactaaactttcggcgaagaataccacactaatctgcagacgcgtaacacctatcacacttagcattccgatttcttgccgccgtttcttcataaaaaatagattggcatacgctaggaaaaaggccgcaaataaaatgataatgatgctggcaatttgaatcgtcccaccaaaaattaagcgttcacccgccgattttagtttagacaacactggatcagttttgatagctgtaaaacaaaagtaaacaacaatcgccataatacaggccatcaaatacgcagcgtaatcgcgggcccgattaatggtacttctaacgaggagtcgtaacagcatctaacgaggagtcgtaacagcattgtagcgacctcccccaccaattgtcgcctgcatatcaatgatttgattaaagaattgttgtcgatcaccactgcggacaatctcagaaaagagctgaccgtctttgatgaagagaatccgccggcaataacttgccgtaaacgcatcatgcgttactaataggatcgtcgtcttctcctgatgattaatttccgttaaataccgtaaaagttcggttgccgattttgaatccaagctccctgttggttcatcagccaacaataaagtaggattggtaatcatcgcccgaccacacgcgacccgttgccgttgcccgattgagatttcatctggatagcggtctaataggcccccaatcccgagaacttgtgtcacttgggcgagtcgcttttcgattaaggcgacgctcatcttatctaacgctaacggtaacaaaatattttccctaaccgtcagcgaatccaataaattaaagtcctgaaaaataaagcctaaatcatgtcgtctaaaattggctaacttagcctcacgcattttcgtcacaacttgatttttgatcattacttgcccatgtgttggccgatcaatcgtcgcaatcatatttaaaagcgtcgttttaccagcaccagaaggtcccatgatgccgacaaattcgccttcttcgatctcaaaggaaatattatttaacgcattcaccagattaaaccgatggccataaactttagaaacttgttgaacggctaccactgtcatatgtttgaaattatgattgttgaagatgatcctacaattgctaacttgattgctgaaaacttagagaaatggcagttaaaagccattatccccgatgatttcgataccatttttgaccgttttttaacggatagaccccacttagtcctactagatatcaatttacccgtctatgacggtttctattggtgtcgtaaaattcgtgaagtttctaaagtgccaattatcttcatctctagccgcagtactaatatggatatggtgatgtcaatgaacatgggtggcgatgattttgttaacaagcccttttcaatggaagtcttaatcgctaaaatcaatgcgcttttacgccggacctataactatgtcgatcaaaatacagacgtcatcgaacataacggccttctaattaacttacaaagtggcggggctcaagttggtgatactgtcgttgacctctctaaaaatgaatataagttactccaatttttgatgcgtcaacacgggcaaattgtcagtcgtgaaaaactcctacgggcgttatgggacgacgaacgttttgtcgatgacaatacattaaccgtcaatatcaatcggctgcgtaaaaaaatcgaacaagccggtctagaagactatattcaaactaaaatcggccaaggctacatcattccataaatgacctttaaaaaatttattcgtgatcatctatttcacatcgtattcttctttggtggcatgtttgtcttagacatcgtcttatggctagatccccatatgcgcctggccaaagaaaccttgatgtacctcgatttcctattaacgattttcttttgtgctttcttgattggcctttacctctaccatcgtaaatggtttcgaacaattcagattcgcctcaatgctaaagaagatgccctcaattggccactaaccggcgctacttcggctgaaaaacagtactttcaaaaatacgttaattcgctattagactatcatcaacaaagcatcgaacgtttgatgcacgctcaacaagatcaaaaagacttcattgacggctgggtccatgaaagcaaagtgccacttgctgcaacgcaattgttggttgaatcgattgaagatcaaatcccagaggagaaatttaatcaactgaccgacgagctcgtacaaatcgaacactacgtcgaacaagttctctattattctcgtcttgatagtttctctaaagactacttggtccaagaatatgctttgaaacccctcatcaaccaaacgattcgtcaaaatcgaaactattttatccaaaaccggattcaattcaaattaactggtgaggagcaaactgtactgacagatgcaaaatggttagtcttcatcctgaatcaaatcgtctccaatgctttgaaatacacgcctcaaaacgggcaaattacaattgatttggcgcatgatgaacagggtgtctggctcagtgtcagcgattctggtatcggtattcccgctgaagatttaccgcgcgtcttcgataaaggcttcactgggcaaaatgggcgtcaatccaatcagcgctcaactggcctaggcctctatctcgctaaatcgctaagtaacaagcttggccacgaactttatgccagctcaacgcccggaaatggtgcgactttcaaattactctttccctttttaagttactataatgatccagacggtgaacgtttgatgggcaaagaaaatcattttagataaatgcgcaaaacaatcaccttaaccctcgcttcactactcttgcttaccggctgtggtgttcaagctaaaaaaacgacccaatcaaccaaaagtacgaaagaagcaaccatcactaacgtcaaaccaaccacagaaaaaatcatccaaggtgccactcaaacttggaccttcggcaaaagggttggttcacaacaaacaaccaaaggtgtgtctgagcaattaaccatctcaccgaccaccagaagcgatgcccaaattaactggacaaccggccaaggtcaaatttctggtaatacagtggtctacaatcaagtatcgtttaaaaactggtctcggaaaacacgacaaagcgttactaaagaaggtcaagatgatcttcactttatgtcggtcactcaaattaaccagacactcaaaaaattaggtgccaatttcaaaatcggtagtttaaatgatctgatttatctagaaacaaagactaaaacgatggttctttctgaagcggtcattgccaaagacgaccacctatacactattaatatcgaatacattacgactgatcacacccaaaccctagaacgtggtgaagtcttcaatagtaccgcaacccaacaaaaaacaacgcaagtccccttaacgcagttaaatggtacttggactgcagccggcacaacggccagtgctaacgatagcggcaaagtactcgtcaaagacggctacctctatcaacaaagctatgacagttatgaacgctccgcaattcaatcgctggcttccgaatcggccgccacccttagaaaaagcgcgatgttcaccgatcagcaaagttctgcagccaaagctggctaccaactcactggtaaatcagttgccagtggcgatagtattgggtacctctacctctttgttaacaatcaaaaattagttcgtattggcgaaggtcttgcgaccgactaccaaaaaacaagcgaccaagtctctgaaaaagagttaccgcaacaaagtatcacgattttcaagcaaatggatgctaaatatcctggcgaggttgcttcaacaatcaccactaaagcggatgctccaatcatcggtatgagcgctagtatcaactatttgacggatgttactgccggtcaaattacggaaaataaatcagttacaaactaattaggcagcttcttgttgttcacgggctgcttcttcttttaatgccattgatgtggcaatcttgataaatggcaagtagataatcgttgaaacgagtaagttaactgcggctaaaaccccgccttgccaactaacagttgccataatcccgccgataattggtggtgttacccaaggtggcatgatggttgctgctggcactaaccctgtgctcgttgcaaagtaagcaattgtcactaagaccattggtgtcacaatatatggaatgaatagaattggatttaatacaattggtaagccgaaagttaatggttcgttgatattgaaaacgccaggtgcggcacttaagttaccaacaaccatgtattgtttgttcttacggccaactaaccagatagcgaaaatcaaacctaatgttgcgcctgtaccacccaagttaacaaatgaatcaaagaatggtttgttaacgatgtaaggggctactttaccagctttaatcgctgtgatgttagctgtaatagcaggtgcattgatagtttgcatgaatggttcgatcatgttggcaccgtgtaacccgaagaaccataagaatggtgtaatgaatgctaataataaagctgaaggatagctgtttgcaagcccttggaatggttcttgaacggctttgtagaatgatgtcacgatattttcaataccaaaacctaataaaattgttgcgaataatgcaaaaatagaaatggtaatcattgatggtaataaagcagcaaatgatttagcaactgcaggtggtaccccatcaggcatcttgataaccaagtgtttgttacctaataagcgtctgaggatttcagttgaaatcattgcgacaattaaggccacgaataagcccattgaatccatgccagccaagccaccaacagcaaagaaagaacctaatgctgtgacgcctgatgctagcggattaacatcgtaagacttacctaagttataggcaactaggaaaacgatgaagacagacaaaatagcaaatgtcccgctccaagcgttccccccaaatttagtccaaatgtaagctttgtccgcgccggtaccaactgtctttgagaaaacactattcataaaattggtatatgccggaattggtaagttattgagtaaggtcgcaaaagcacctaaaatcatcaacggcattgttgtcacaaaggcatcccgaatggcaattagatgtctttggttcccaactttagcagcaactggtaagaatcgtttctccatgaaactgataaatgagtccatttaatggactaatttatcccaaataacgggcttaccagcaaccaatgatttcggtacatcgataatacgttggttactgctgcctctaaattgtaaggttaaatccatcttatcttgcataaagcgaccatccactagaatatcgatttgcgataacaattccagtttatcgggtgactcgagcattaattcttcccaagtataacccgtccacgaccaaacgtccttagtctgtccgtaggtttcatggatgcgatcaaccaatgacaggcacgtttttgtatttaagaaaggttcgccccccagtaacgtcaacccttgaacatacggttggccaagatcatcaatgatttggtcctccagttctttggtgtagggccggccatatttaaaattctgggcaattcggttgtaacaacctgggcaggcaaataaacagccactaacatacaaactacaacggacaccttcaccatcaacaaaattaaatggtttgtaatccgcaatataatcctgactaagttcttcagacaaccattcttgtggtgctgggttcttaggcccgcgtttcgtatttcccatttattgtcttgcaacgttattattatcattaccaatcgtgatgtgcatatgtttgacacgacttgaaatttccttatgacggccgtgaaccattggccgttgttgtgggttacctaaataaccacaagtccgtttaacaacgtcacacgttgctggatctgtgttcccacattgtgggcattggaagccccgttcagttggtttaaagtcacccttaaagccacacttgaaacattgatcaattggcgtattggtgcctaaatagccaacacggtcataagcgtaatcccaaacagcttctagtgccttaggattttgacgtagatttggatattcacaatagtgaataaagccaccggcacaatatttaggataatctttttcgaagtctaacttttcaaatggggttggcgccttgcgaacatcataatggaaactatttgtgtagtattccttgtccgtaatgttttcgacaatcccaaatttttgcgtgtctttttggcagaaagtattcgttaaactttcagcaggtgtgctataaactgagaaatgataaccatattctttttcccaatcaacacagtggttatagaggtccttaaccacgtctaacgtgaattgcttagcagttgcatccttttcccaatctgggccaaagaaggctgcaccgacttcatagaggccaatatagcccaatgaaactgttgcgcgtgaattcttgaaaacttcatcaacactgtccgttttcttcaagcgtttgccaaaagcaccgtaacgataaagaattggggcgttttcaggtttagcttccttagcacgttccactttgaagacgagggcttccttgcagaccttcaagcgttgttctaaaatttcccagaacttagcttggtcaccagcagcttcaagcgcaatccgtggcaagttaactgttacaacacccaagttcatacggccactgttgacctcttgtccttgttcgtttttccagccttgtaagaaactccgacaacccattggtgccttaaatgaacctgttaattcaactaacttgtcatacattaaaacgtcagggtacatccgcttagttgcacattcaacagctagttgtttaatatcatagtttggatcagttggggctaagtttaaaccacgtttaacagcaaaaacgagtttagggaaaatagccgttctcttttccttacctaaaccttcaattctaatttctaagattgctttttgaatggcacgttccatccaacttgtccctaaaccaaagccaagtgtcgtgaatggtgtttggccttgtgatgaatataaagtattgatttcatattccaatgcttgcatcgcatcataaatatctttttcagtcttagtttgtgcgtaagctgtttgtttggcttcgccatcaatccagtttttagcatccgttaaatgcttgtcgtagttcttctgtgcaaaaggtgccaataattcatcaactcgatcagctgaacagccaccatattggctagaagcaacgttggcaatgatttgtgacatttgtgccgtagctgtttgaattgaatgtggtgcttcaacttcggcgttcccaatcttaaagccatgattcaacatttctttaaaatcgattaaacaacagttcgtcattggactgtatggttggtaatccaaatcgtgccagtgaatttcaccttttagatgcgcattggcaaccttaggtggcaacatcttaaggcccattgccttagcgacggtgccggccgttaagtcccgttgtgtgttaaacacttggctatccttattggcattttcattgactacggtttgatccttagccaataatttttgaatcgtaaagttaatatcagttgctttattgcgggcaaaatcccgttgtgtccgataattaatatattcctgggcgatgtcatattgatgatgttctaatagtttgtgttcaacaatattttgaatttcatagattttaacgtctttatcaaaccgcgcaccgacttcgctcacgacgtcggttgccactgaatttaaaatttgataatcaagtggttctaattcatccttaacgtttttagcagctttaatgactgcttgttcaattttatccgctgaaaagggtaaaatacgtccgtcacgtttgacgactttaatctctaaatccatttttgggtcttgttcttcacgtatttccaacatttaattttttaattttaatgtcatcgcattaattgccacgacaattgttgaaagcgacatcaagatggcaccaatcgctggacttaaaattaagccccaagcggcaaataagccacccgccaatggaattgctaaaatgttgtaaccagctccccaccaaaggttttgcgtcatcttccgactagtagcatgtgctaaattcaagaaatgcatgatatcgttcggattactcttaaccaaaatcacatctgcggaatcaattgcgacatccgtgcccgcaccaatcgcaatcccaatatcagctcgcgtcaagctaggggcatcgttgacaccatcgccaaccatcaagaccacttcaccctttgcttggtaatcttgtacaagtgcttccttatcttctggcttcaaattggcttgaactgtcataccacccaattgttgcgccaccttttcggcaacctgttgattatccccagtcaacatcaccggttggatatgacgctttttcaatgccttgatgaacgtcagtgcttctggtttcaactgatccccttgcgcgaccaatcctaagacagtttgaccttgaattagataactaatggaattacctttagccgccaaagtttcaaaggctgccgtatcaaatgcgatttgcttttcttgtagataatcggccgtaacgatttgataagtttgcccttcaattgcgcctgtcagcccgattccttgaatcgtttgtacattttcagcttgggacatcgtaattttttcagcgtcattataagctaaaatcccagttgccaatggatgacttgagtgtcgttccaaagcacccatataagccatcaattgagtttttgacatctcgccagttggttgaaccgcattgaccttaaaagccccttgcgtcaatgtccctgttttatccattaaaaccatcgtaatttgatctgccacttcaattgcttggcgattacgaattaataagccgttagttgccgcaatcgctgtacttcgagcaacaactaatggaatcgctaaaccaagtgcatgcggacaagcgataatgaagaccgtcaccattcgttcaaatgcagtatttaaatcagctaagaaaaaccaactgataaaagcaataataccagccactaatgctgcgtagaaaaggtatttagcgaccttatcggccaacccttcgacctttgacttttcttgttgtgcttgtttgattaacttcatcacctgcgctaaataaccactctcaccagtccccttgactttaacggttaatgtcccgtcgccattgactgttccaccaattacttggtcgccagtctttttagcaactgctttggcttcaccagtcaccaatgattcgttcacctgactttgaccattcaccacaagaccatccgctgggactttttcgcctgctgccaccaacacggtttggccttcttgtaaatccttcaaatcaacagcgtgttgctgaccatcttgatcgagcacttgtgcttggccgggtaataaggcggccatcttctccatcgcactcccagcgctcataacggcgttcatttcaatccagtgacctaacaacatgataacgattaacgttgccagttcccagaagaaatccatcacgtgcgtttgtgttgccaagaaatggttggcaataaaagcatataaactataaccgtacgataccgtaatccccatcgcaatcaacgtcatcatcgctgggttcttctcggccaattcgccctttgcaccttttaagaaaggcgcaccgccgtaaaagaataggaaggttgctaataagaggactaaccaatccgatcctgggaacgtggtttgaaacggtaatttaatccccataaaaggcgataatataataatcggaattgttgcgactaatgagacccagaatttctgtttcaaattacccatgtgcatcatatgtccaccatgcatcatcatatcaccgtgatcatggtccatatcatgcatatcgtgcatgtccatttcccccatctcatgatcgtgcatctccatatcatcgtgtttcatctattcctccttttcacagtcacatttatttggcaaacagtcgcaagccactttttctggtgcagtagctgctttggctgttagtagttcttgtaattgtaaaatatccgtctgactcaaagtcgtttgatcaattagagcggctaacgtctgcccttttttcataccacacaagtgttcaaaaaggctctgcgtcgcattgtccatcgcttcaatttcaggaacggttgccgtgtaattaaaacgtcgcccttccttttctgtctttaagaagccctttttaaccaaacggccaatcaatgttttgatagttgaatcttgccaatcacgcttttgttgaagtaaatcaattaaatcacgactattgacttgcccaagtgaccagacaatgcgcatcacttcccattcggaagtcgtaatttcatttgtattttctgccatctaacgatctttcataaaatcttcgactaatttttgattttcttcgttgcttgtattgacgttaacagctgtttcaactaaatcagttaattcagttgtgtctaaacgtttcatcaaactacgaactcgtaacacagaagttgcgctcattgagaattcatctaagcccatcccgacaaggagtggtgccatgattgaatctccggcagcttccccacacataccagtccacttaccttctttatgagaagcgtcaatgacgttcttaataagacgtaagattgctggattataaggttggtaaaggtatgaaacacgttcgttcatccgatcagcagccattgcgtattgaatcaagtcgttcgtcccgatactgaagaaatcaacttctttagcaaattggttagccaatacggcgctggctggaatttcaaccatcatcccaacttgtaaatcgtcagatacagtttgacctgcagcaattaattttgctttttcatcttcgagaatccctttagcttgacggaattcagcaacagttgcgatcattgggaacatgatccgtaacttaccatagttagaagcacgtaataaggcgcgcaattgtgttctgaaaatgtcatcacgatctaaactaatccgaattgctcggtagcctaagaacggattcatttcttctggtagtggtaagtaaggtaatttcttatccccaccgatatccattgtccgcacaacaactggtttgccgtccataccttctaggactgttttataagcttcaaactggtcatcttcactaggtaactcagctgaatccatatataagaattctgtccggtataaaccgattgcttcagagccgttttcaaggacaccagctaaatctttaggtgttccgatattagcagcaaccgtgaatgttttgccgtctttagtgacggacttttcattctttagtttttcccattctgccttttgatcagcaaaggcttgggccttcacatcatattcagcaatatcagcatctgtaggatctaaaacaacatcaccattaataccatcgacaattaataagtcgccagctttaacatcttgtgtgactgtttcagtcccaacaattgcagggatttctaaagaacgtgccataatggcagaatgtgacgtccgaccaccaacatcagttacaaaagccttaacgaatttaccgtttaattgggctgtgtcactaggtgtcaagtcatgagcaatcacaattacttcttcatcaattaatgctgggttagggagtgttacccctaataaatgactgagaactcgcttcgtaacatctttgatgtcagcagcacgttcttgcatgtatgcgttatcagtcatagcctcaaaagtggccacgaataaatccgcgacctctttcaacgcttgctcagcattaaccttgtcatcattgattttaccttcgatagcgccggtaaattctgggtctgctaaaatcatcatgtgagcgtcaaaaacttgcgcttcttcttctcctaatgattcagcagcaatcttccgaatggtctctagatcactcgtagaatcttgtaaggccttatgcaaacgattaatctctttttctgaatctgaaatagttgatttcgaaaatgacaaatcgggttgcactaacatgtaggctttcgcagtagcgataccatcactggcagcaatccctgttagtttagtcatttattcagataaaccttcctttttcattgtttcttcaattgcgttgattgcgtctgcttcatcagcaccttcagcagaaattgtaacgtctgcgccttggccaacaccaagtgacataacgcccatgattgatttcaagtttacagatttacctttgtattctaagttgacatctgagttaaatttgcttgctgtttgtaccaataatgtagctggacgtgcgtggatacctgtgtctgctactacgtgaaaatcgcgtttttccatctacactataccgctttcagcacagcggtaaatcacctgcccatttcgttgggcagcgcctacaatttcttttcgatggtcgtaattgacccatactttctgaaagtctaaaaactcatcatgttcaacgacaatggtttctttttcgtgatttaacaaggcatccatctccgctaaaaaatctcttgccatatgctttgtcaaaattgtcaaaaaaatccagcaacaatccatctctacactagcgtcaatggtcaaaaccaagccattaacctttgtcaaaactgttatcaagcactaaagcaacaaggaatgagtggtcaatataatgatccctttggttttagtaatcttgatgaactcttcaatgcaatcaacaatccaaacgctgaacgcaatgctgctaaccaaggcccccaaacacaaggtggccgtaatggcggcggtaacaacggtcaaaatggtgaaagtctactcagccaatttggtgtgaacctcaccaaccttgctaagggtggtcaaattgatccggtgattggtcgcgataaggaaatcgcgcgcgtcatcgaaattctcaatcggcgtaccaagaataatccagtcttaattggtgaagccggcgttggtaaaacagccgttgtcgaaggtttagcgcaaaaaattgccgatggcgacgttcctgctaaattaaaggatcgccaagtgattcgcttggatgtcgtttcattagtacaagggactggtattcgcggtcaatttgaagaacggatgcaacagttgatcactgagctcaaacaaaataagcagattatcctctttattgatgaaattcacgaaatcgttggcgccggcaatgctgaaggcggcatggatgctggtaacgtgttgaagccagctcttgcgcgtggcgaattacaactcgttggcgccacaactaataatgaattccgtcagattgaaaaagacgcagcccttgcacgtcgtcttcaaccggtcgcggtcaacgaaccatctgttgacgaaaccgttctaattctcaaagggcttcaagataaatacgaaagttatcaccacgttcactatacggacgaggcgcttaaagcagcagcggccctttctagtcgttatatccaagatcgttatttgcctgataaggctatcgaccttttggatgaagcaggctctaagaaaaacttgacgattaccttgatggatcctaaggaattagaagccaagattaaatctgcagaagcacaaaaacaagaagccctcaaacaagaagattacgaaaaagcagctacctatcgtgatcaagtcacacagctctctgaaatgaaagctaataattcagttgaaaaatcccaagaaccaacaatcaccgaaaaggatatggaaaaaattgtcgaagaaaaaacccatattccagttggcgaattaaaggcgcaagaacaagctcaacttaaaaacttagcgcaagatcttgaagcacatgtcattggtcaagataccgcagttgataaagtcgctcgttcaattcgtcgtagtcgaattggctttaataaatccggccgaccaattggctccttcctctttgttggcccaaccggggttggtaaaacggaattagccaaacaaattgccaaagaactctttggcagtaccgatgcgatgattcgctttgatatgagtgaatacatggagaaattcagtgtgtcaaaattgattggttcacctcctggctacgttggttacgaagaagccgggcaattaacggaacaagttcgtcggaacccttatagtttgattcttttggatgaaatcgaaaaggctcaccctgacgttatgcacatgttcttacaaattctagatgacggtcgtctaaccgattcacaaggtcggactgtcagcttcaaagacacaatcattatcatgacgtctaacgctggacaaactgatgctgaggctaacgttggtttcggtgcagctgtcgctggccaaacccattcaattctcgatcagttaacgaactactttaaaccagaattcttaaatcgtttcgacgatattattgaattccaaccattaagtaaagataatctattaaagattgtcagcttaatgcttgatcaaactaacgcgatgattgccgatcaaggcctccacattgctgtgacggatgacgctaaatctaaattagtcgatttgggctacaaccctgaaatgggcgctcggccactacgtcgtgtcattcaagaacaaattgaagaccgcgttgctgattattatttagatcatccagaacataagcaattaaaagcgcagttaaatgatgatcagattcaaattgtgcaaggataaatgagactcattaatattacaaattcttatcaccgtttagtaacacaacaattagcaaccactaaagccgactatgtgagcgtctattcgcttggcaaaacaacagtccttttcacccgctcatctaaaacgcgtgaaattcttctaaaaaatgacaagcgacatattcaacaagctgaaattgattttgtactcaaggaattagtagatattgattcaaccgacgatgttgaaatcctaaacgatggctcattagttgagattaccattccaaccccttctactaccgcctcttagatgcaaactgttcaaaaagggcaacaaattatttgtcgtttagaagttggcgatgaactcatcaccgaattgaaatatttagccgctactttaccggaccaattaggtgccatctcaggaattggtgcctgcaatgatgttactgtcagtatttactcaccagacagcgacagctacgttgaaacgcgcagccaagaacaggttgaactcctatcactgagtggtaacgttgaaaatgcggatggtaagatttcaactcacttgcacgccagttttgcccgcttagacacaagcgtttttggcggccatcttgaacgcgccgttatttcaagaactggcgaactcgtcatctcaatcgtcccccttgctgttgggcgtatcttgcatcaaccaacccaattacaagtactcgatttatcataaatgaattttattaacctgattcaatcgttatttagacggcggccaaagcgcccaaccattcaaccagagacgcactttaatcaagctactcctgaaccagaaaacacaaatcaattcttcgagacagctgatgaatttgaaaaagaaccccaagcgcagcaaactgaacattttgtcacaacacctgtccaaccacgcaaaagttcagtgacgatccactacctcaaccaaaatcgaattccactgcggccttcgattacactttctggagtagttggcgctacgcttgatttaccgtggttaaaatttcctggctactatttagccgaaattacaaatttaaaacaacatttccatgaagaccccactaacatttggcttttttataaaccccaattagcggcaccagtcatggtacttcatcaagatttagaaggtggtttgctgatcaaaccccaatttttacttggcgctttgaatgaacactatcaagctaacccgttagaaggcggtgtgaacttcatctatcgcacttctagtaatcaaacaggacgttttagtgctgaaacgcagctagtacggttccaatatgatccacttaatctaaaatacagcgatgcccctgatcaaccgtttattgaattaaccgcatcggttgacacttacaaacggccgacagaagaagcactcaccacgacccgcttacctaagaatgcaatttggaaaatttatagttgtgcaacagctacttctggtcaacaatggttcaacctcggtagtttttggatttcacccaagcattatgaactccatgcaactaaccctaaggcaacggtcgattaccaagtccccaagtttaccaatcaatatacggttattgaaaccacaccgcttaatttagatgcgactttgaataacacaacggcaacattatgggccgcgccttacgaaaaaccggctacctatcgccttgctttgaagactcgcgtgcacgtcaagcaagtgattgcgctcgacaatctcagtcggtggtgtgaacttgaaggtgggcagtggctattagaatcactactaacatttgactaattataatttagctgttaatttaacttctgggtacttatcttggaaccagcgttctgcaaatttattttcaaataagaagagtggttggtcgtgaatatcttttacaagtaagttccgtgatgatgacatactttgatctaatttttcaggatcaatccaacgagctgttcgtgagccgattggttccataatcacttcagaattatattcatgttgcatccgatattggaaaacttcaaattgtaattgaccaacagcacctagaatatagtcgcttgttgtgtatgtcttgtacaattggatggccccttcttgaaccaattgttgaatccctttatggaatgatttttgcttcattacgtttttagcagtgacgcgcataaataattctggtgtaaattgtgggagtttttcaaatgagattgcttctttaccagtatgaatcgtatcaccgatttggaagttccctgtatcatacaacccgacaatatcaccggcaaccgcactcgttacttgttcacgagcatcagccataaattcagttgaattattcaaccgcatcttcttaccagtccgcgtcaacgtcacgtcaatcccgcgttggaattcacctgaacaaacccgtacaaaggcaattcgatcacgatgggctggattcatgttagcttgaatcttgaagatgaaccctgagaaatcttcattcgttggttcaacttgtgtttcttcttgtgtttgatgagcttctggtgctggtgccatatcaacaaaggcttctaagaaagtcttaacgccaaagtttgttaaggctgaaccaaagaagattggtgtttgatcaccagtagcaattttagcgggatcgtaagcattacccgcttcaccgattaattcgatgtcatctagtgcttgtgtgtaaacagaatcttccttcaaaggattatcgccagcaatcttgccttcttcatctaaagcaagataaggattggcttcatcttctggacgatacatttcgattcgtttgttagcaatatcgtataggccacgtaaatctttacccatcccgattggccagttcatagcacaaccttcgatatccaataattcttctaattcagcaattaaatcgagtggttcgcgaccatcacgatccaatttattcatgaatgtgaaaattggaataccacgcatcttgcagactttaaataatttcttagtttggggttcgatccctttagcggaatcaattaccatgacagcggcatccaccgccatcaatgtccggtaagtatcttctgagaaatcctcatgccctggcgtatctaagatgttaatccgtttgccagcgtaatcgaactgcatcacagaacttgtaacggaaatcccccgttgcttttcaatatccatccagtcagatttcgcaaactggccactcttcttccctttaacggttccggcttgacgaatcacgcccccgaataataagagttgttcagtaattgttgttttcccagcatccggatgggaaataattgcaaaagtccgccggcgttcaacagccgtttttaattcagttggtgtcatttaggcctcagacgcatcatcttttgcagcgaccgtcgttggtaatgttagtttcaaatctaataaacgtgaaccgactaccgaaccagttgttaaaacaatgccgttcggtaaatcgattgattctggatgaccactgacaggaattgcaccaatctcagtaatcataaagccagcaatcgtatcaacatcagcgatttgaatatcggtctgaaaggcatcgttaaattcattaattggcatccggcccattaccttgtagtgggtctcgtcaatcttctgatacaacacatccgccttatcggattcatcttcaatctcgccaacaatctcttctaataaatcttcaattgtgactagcccaacaacgccaccatattcatctaacaagatggccatctggagttgggtgcgtttcatttcgaataataagtcatcaatcacgattgtttcaggcacaaacaagggttctttcatgacagtttccaattgtgtttctgagaagcccttctcacgtgcttctcttagtagattcttgatgtggacaatccctacaatttgatctttatcatcccgataaactgggattcgtgaaaatggttgtgctaaaatagcatcaatattttggtcattgtccgcacagatatccaccatgaaggcgtccgttctgggaaccatgacctctctggccatcttcttattaagggtaataatcccttctaacatttcgtactcgtcagattctaaaacccctgcacttttcccggattcgatcatatgaaccatctcttcacgggttagtttgggttctgtctcagaaaaatcaattggcgttaacttcatcaaaaccgtcgttgacgctgatagcaaccaaacgaatggtcgcaataaaacgccaatgaagcgaatcggttgaactgccgccttggcaatcgcttctgagcgatgcagggcaacttgtttgggatataattccccaaaaacaagtgagatataggataagacaatcgtcacaattaatacggctgcttccttcgtccaagccgcatttcctaaaaggggtgctaatctacccgcaatggttgtggcagcactcgctgaagataagaaaccagcaaacgtaatggcaacttggatcgttgctaagaaattattggagtggtttaaaacctccactaataagcgcgccttcttatcgccattttctgcttggttctccatcttcgtgcgacttagtgatactagcgcaatttctgccgcggcaaaaaaagcattcactaaggttaaaattaaaatcaacagtaactgtccccacaccggacttccagggtcaggattcatttataatttagtcgctttatcgactttagtgcgtaaagcttgaatatcgtataaataaacaacgactgttttggtaacggcataaaacggaattgctaaaatcatccccaaaataccatagatattgccggcaactaacaagataatgataattgttaatgggtgaatatctagagaacggccaatcacattagggtaaatcaagttcccatcaatttgttgcacaataactactacgacaatcaccatgattgttttcggaattgaaattgataaactaataattaaagcaggtgcaatcccaatataaggaccaagatatggaataatgttggaaacaccggcgataaagcccaataagtaggcatatggcatcccaataatcaggtaaccaataaaggtgaaaacaccgacgaataaacattctagcgcttgtccgccaatataagctgaaatggttgcacccatcttacgtaataaatcagcgacttgatcgttataacgatctggtaacatcttttgaatatttggaatgagtcgatgaccgtcttttaacatataaaagagcatgattggtacggtaaagaccccaattgtcacactcgtcacggccccaatcatgctgccgaaaccactggtgaaactcttcatgatgttttcagcgatcttagaaggttttaagtctaattggtcaacgtatttattaacatcgatattcttcaaatgcggatttgttgagatcttatcaatcatatcctgcaagcgatgcacataatctggtagattcgttaccacttgtgttacttgatggattaattgcggaatcgctaaggctacaatgaagataatcccaccgaaaaagacgatgaaaataatcgcaattgcccatttccgtgatatttttagcttccccagtaaattaatcaatggattaaataggtagaacaataaccctgccccaatgactggcccaaacaaggttgaaataaaggtccctactggatcaaataagaaactaattttagtacaaacaaaaattaaaacggccaagattaataattcagttgaccaaaacaacaattttgattgacgcaaacgctcaaacatatgcaaattaaacaaactcgtgatttaacaagtccttactacctagatggcctcactattcgccaagcggtttttgtcgctgaacaaaaggtccctgctgaaatggaaatcgatgaatttgaagaccaagcactctatttcacaggttatctagatcaacaacctgttgccacattacgcgtattgaccgagggcgccttctatcacgtgcaacgggtcgctacaatgaaagcttaccggcaccaagggcttggattagagttaatgcaagcagctgaagcatccgcaaaaaaagccggtcataaaggccttattttaaacgctcaagtcacagccgtcccattttatgaacgcttaggctatcaagcaactgataaggaacgcttcttagacgccggtattttacatcaagaaatgattaagatcatataaatgtctaaacaaaaaatatttttcgttaatctatttttcttcgttatcccttatttactagttgttacaattgctgccatcgcttatgacagtttggttgtgcatagcgctacttgggatcgtacaatttttggcggtctcgtcggtggaatcctaatcctctttacaaaagtaccgcttgaacggccactaacaattatgactgaacaaactaagaatcctgttatgcatgctattttgaacttcttcattatcagtcgttcaactgcttataaaattggcaacttcgttttagatttcgtactcttttgcctagcaacgtatctactaagagactttcttcccatccaaattatctctggtagcttacttggttggtgtgttatcgcaatttttgcttcaattagcatcgcaacagccctcggtttcaagacactcacaattcaacaagacacatcggtagaaaacaattagatgagtgccatcaaaacgattgctattatggtagctgctgacgagcaatacgccgatcagatgttactgacacttaaatcgattcgagaacattgtgctttagaaacggctgttgatttatttgtcttgagtagcgacctctcctacgcaactaagtccgccgtcaatcgcttaatgacgctaccccatcatgtctcatttattgccattaatccccgtcgcatcaaaaatttcccaggaaataatcattttgaccaaactgcctattatcgaattctagcaccacaaatcctcctcgccagacatattgagcgagtactctatcttgatctcgacacactcatccgaaccgatttaacgcctttatacgacagtgatttagaggggaatattatcggtgcggtcattgaccctggtaaggcactgaccttaaaaagacttggtgttcctaaatcgcaagccaataatatctattttaatgccggcgttttgataatcgataccatgctttgggaaacacaccatatcagccaaaaaattcttgcgatgctagtgccttaccctgggcgccgtgttaatgatatccaagatgcgctgaatgtcgttttggcgggacggactaagttattggctcccaagtggaacgttcaaaatgccattttatttaaaacctatgagccaattaataatgagtacaatcaactctttaaacaggcaattacggctcctaaaatcattcacttcaccactgagaaaaacccatgggaagtctttttagagcatccttatatgtccgaatatcaggtctatttatcacaactacctgctgacaaacgtgatcaaatcaatattgtttctgcggctaattctaattttgtggaacccctcgcgattttatacgcctcaattctgaataataacgatgataaccgccattatgccttttttgttttgagtgatcagctaactgctcgcgatcaggcaaccttgcgccaaatcactgaaagttttaatgccgaattaacctttattgaagttgacgaaacaccactaacggcggtcattcaagatgaccaagttttaaaaactgcctattaccgattactgattcctaatctactacccgagattgaacgcgtgctctatttagattgtgatacactttgtctggaaaatctcgcgcgtctgtgggacgttgaattgggtaacataccagtagccgctgttgaagatgccggcttccataatcgattggctcaaatggcaattgactacaagagtattcgctacttcaatgccggtgttttattgatgaacctaaccatctggcgccaacaaaaaataacggaacaaattttgaccttcattaaagaataccctcaaaaattacgatttcacgaccaagatgccttaaatgcgattttacatgatcgttggattcacttacaccccaaatggaacgtccaaactagcattttgatggactttatcgttgcaccgaccgaacggattaaccgtcaatttctaagtgcgcaaaaagaaccgggactcattcatttttgtggctcagaaaaaccatgggataaaagttcaacccatccttatacacctcagtatcgcttttataaaagccgctttttagaaaataacaatccggtgccttttagagcaaacaccacttttgatgaatatcattcttaactaacggtggtgagccaattcttgatatcggttataccagatatcaatatattccttcgaaaatggccctttgccattgttgatccaatctaccaaaactttgacattggctttcaatatccgatcagtttcggcagaatagtgccacttcgcactatgcgcttcatattcatcgacgtctaacaagcgtttctctccgtttggaaagaccttcacgtctaaatcatagtcgatatacttcaacgcttcttgatccataacgtgtggcgatgccaaattgcaataatatgaaacgccgccttcgcgaatcatggccacaacgttaaaccaatacttcttatggaaataaataagtgccggctccctcgtgacccactttctgccgtctgattctgtaactaaggtatgatcgttacaaccaatgactgcgttctcgctggttttcaaaaccatcgtgtcgcgccaagtccggtgtaaactcccatcgtgtttataactttgaatcgctatatagtcgccttctttaggtgcattcatctaaagtgagtcaaatcgttgcgccattttcttttgaaccgttggcattgcaatttctgctagagctgcttttgaataccattcacctgggaaaaaggccaagtcgctgtcttttgcaatcgtcgccgataacaacgtaatcgtccacttcaaatgggtaaaaacgtgcgtcaccggtttgacaggcaccggttttaaatgcgctaatgttaaaccatacgcctctttgaagtaggcttcaattcgagtcatttgctcttctggcgttaataactcagactcaccatcctgtaaatcttctgccatcaccaaaggataggtcgttaaattagccagcaaacctgtgctaggtcgcttttggaataaaaagcccttttcagattcaatcacaaccgcaaaaagcgcaaccggttttggtttagccttcttcgttttaaccggataatccaacaacgtgccatcttgataacttctgaaaaatggtgctaattcggtgtccccaaccgttggatttttggctgtacaaacttgcgaaccaaaatccatgacagcctggttgaaatcgccaggtcggtctttgggaattaacggtaaaatggcgtcgtaaaaaatactacgattcttcggattcgcaatatcagcgtcaatttttaataaccgactgaagacccgaaaagcattcccgtcgattgcgggaaccacttcgccaaaacagatactggcgatggcgcctgctgtatacgggccgataccggctaatttttctaactcagcaaatgtttgcggccatttgccctgatagtcatcaactacttgcttagccgctttttgtaaattacgcgcccgtgaataatagcctagcccttcccaagttttcaagagcaactcttctggggcagctgctaggtcttcaacggttggaaaagtcgctaaaaagcgttcgtaatacggaatcaccgtttggacttgcgtttgttggagcataatttcagacaaccagacccggtaaggttcttgattttgacgccaaggtaaatcgcgacgatgttcgtcgtaccatgccataaaagcagtctgaaacgcctcacgttcactcggtgtcatctgatacttcttggtcgtcgatgaaacggttgattgcattcactcggtgtcatctgatacttcttggtcgtcgatgaaacggttgattgcatcaatattaaatcctttccggtaaagtgcttgttgcatcttcatccgccgctcgcgcggttctaataggcgataacggcgccattttttctcgccaagggctgccaatgcatctgcttcactatcactgtcttcttcaagcgctaattcgtcaataatccgacttaaattatcaccaccaaagcccttttgcatcaagccttgtttaatcttttgttgttgttcgaagaacgaactgtggcggtacttcttcgctagcttttgggcagttgctaagccgactgtcacttgttcttcgtctgtatatagcgtcaacgcttgatcgatatgattagcactaacccctttttgaatcaatttttgtcgaaccactttaggccccttatccgaagtattaatcaccgttctaacataactgtccgcgtaatcctgatcatccaaataatgtagttcgcgtaattttgtcaaactggtttcaatgccttctggcgtaatttcatgatcacgcaagtattgtgttaattctttttccgttcgtaattggtgacttaaataattcaaggccagttgataggccttggcattgtcatcttctttttgaatgtcacgttgtaagctactatcgatttcgagcccttttgcaagccgaaacttgattaagacactttcagtcaccccaaaggcaaactgctcgtcgataaaaatgttatagcgccctttttgtttttgtgaggtaattttagtaatctgtggcatttattttctcccgttacgtgtcgctttgacgttcagataaatcttaaagccaatcacgactaccgctaaaatcagggtgccaatgattaatggcaagctcttcgcttgaaaagcatagatcccaattgcaaggactatcaccatcgcaattaaaaattgatttcgttcccaaaagttcatatgccagaacaaacaactactaatgaagtcgaagtcggccaacgtttcccactgaccatcaagcgaatcgggattaacggtgaagggattggttattacaaacgcaagattgttttcatccccggtgcacttcctgaagaagtcgtgattgccgaagtcacaactgttgccccccgcttcatcgaagctaaggtccacaagattcgtcaagaatcaccacaacgggtcacacctagagatgccacttacggtcaagttggtgggattgaattggaacatctcagttatcctggccaactcgcctttaaaaaggatatgatgatccaagccttagaaaaattcaaaccacacggctacaatggctatcaagtcactgaaacggtgggcatggaaaatccatggcactaccggaataaagcacaattccaagtgcgtcaattaggtgaccatttaggcgctgggttatacgccccaagcagtcatactttgattgaccttccagaattcgcaacccaaactgatttaacgatgcggattatccgcactgttttaaaattagtcgaagacctcggcattcccgtctttgatgaagaaaagaacgccggtatcttaaaaacaatcgtcgtacgtgaatctttctcaaccggtgaagcacaactcaccttcatcaccaattcacccaaactaccaaagaaatatgcgctaatcaccgccattcaagctgaattacccgaagtggtctcaattatgcaaaacgtcaacaaagggaaaaacgtcttggtatggggtgaccaaacaatgcaccttgccggtcaagaaacgattatggaaaacctcaacggcgttcagtttgaattaactgcccgcgcctttttccaactcaatcctgttcaaaccgctaagatgtataacttggttaaagaagcactcgatttaacccctgaagatcgcttagtcgatgcttactgtggtgtcggcactatcggattaagtcttgccaatcaagtcgctgaagtgcgtggtatggatacaattgccgactcaatcgaagccgctaaacataacgcagagatcaacgggatcgacaatgtggattatgccgttggtgcagctgaagacctcttaccagaatggttagataacggctttgtcccaacagcccttgttgttgatccaccacggactggtcttgatccaaaattaatcgatgcaattctcgacagccggccccttaaatttgtttacgtttcatgtaacccttcaacgctcgcgcgggatcttaagacattggttcatacctaccaagttgaaaaaatccaaccgttagacatgttcccacaaacggccagagtagaagcaatcgtcacaatgagattaaaaagaaatctataattagttttctttcactttagctctcaaaaagaacgtcacaagcggattatcactgtctgtttctaactgatttgtttttaataatgccgtaattaataacgctaagccgatgacagccgaaataaaggcccaaccgcgagattgctgactatagctggatgcaagtccatttaaaacccataaggtaacggcgccccgaccgtttaaaccagcatcccgataacgacgaatactaagtgcaagtgttggaataaatattcctacagcgataattgcaaagatgcccaaataaatccaaggattaataccagctacatgacctttagtgattaataactgtcctaataatataaatagtggtatataaagtattaatattattattcccattacccaccaataacctgcccgcgtacttcggcccataaagtcaaaataacctttaaagtaatcccgaaatgctgtcttaattgtcactttaccaggtacttcttgaatttcacgcatatgaaaatttattttgcaaatgcactcttctcacaagctgattttgattacaatacgcgcgtggttgctgcgttacgccaagcaatgccaaccttagatatctatttgccacaagaaaacgcagcgatcaatgataaagaagcctacgctaattccgaaatgattgcccaagctgataccgaacaactggttgccaatgacctagtgattgcggtcttagacggccctacaattgacgttggggtggccagtgaaattggtgtcgcatacgcccgtaacatcccaattatcgggctttacacagatagtcggcaacaaggcgccacgaattcacaaaaggtagccgctttgcaaaccattgctgaaaaccaattccattacctcaatctttatacggtgggcttaattaaattaaatggcacgatcgtcaactcagtcgatgctttaatcgaaaccgttcaaaaatactaaatgtatgatcaatcgataaaagaatatcgctgtaatatttgtcaacaaacaatcactgtcaacgaacactgttggaccaatattcaattaccccctggtcgtttcatgaacggttatatagatattcgcgaaaccttaaaaattacgaacgcccaaataatttgccagagttgtgcccaacttatcaacaagtcaatcgatttggaccagattcgaacacaagcctcagatactaaatcatgactatcttgtcatatatattctttcgtggtccttcacgccttttaggataattggggcgttatccattgtgaggtcaatttcgtattcactaccgtcttctggtagttccgtttggaattgtgtttcgtattcaaccatcgtgagttggcgacggttggccaatagatcagcatgtttttgctttgctaattgtttttcgaaacctggttgtagaatccctgtgaaaaattcgctaacggcacctgatccgtaactgaaaagaccaattcgatcgccagcttctagattagttgagtgttccaataatgaaagaaagcctaagtatagtgcacccgtatagatattcccgatttgacgactgtacaaggtactttcagcatagcgttctaagagttgtgcttgttgtgtctcactgccttcatctagaattgtccgcaatgcttttagccccatcttagtataaggtaagtggaaagctaaagccttaaaatcagcgattgtccgacccgttttagcacggtaatcagcccatgtcttttggaagaattcgatgtattgttctgtggaatatttgcctcgtgcaaaggcctctttagaatagtttggacgccagaaatcttgaatgtcttcactgtggatacttgtttctggttcaagaaccatcaaacgtggttgggcactgaccaacattgcaacggcgccggcaccttgtgtcacttcacccggtgtttctaaaccgtagcgcgcaatatcagaaccaatcaccaatgccatttgatccggatgagccgcaacataatcataagctgtcattaaaccagcagttgccccgtaacaagcttccttaatttcaaaagtccgtgcattgctgagacctaataagcgttgaatatagatagcaccagctttagattgatcaatgcctgattcagttcctaaaatcaacaatgaaatattgtcgcgtgattcaccttctaataaatccaaagcggcgttagcgcccattgtgacactatcttggcttaatggtgcaatcgccatttgatcttggccaatcccaattgtaaatttatcagggtcaacaccacgcgcatttgctaacatgacaagatctaaataagtatttggggtaaaaaggcccaatttatcaattccaatttgcatctatctgttttcagcacggatttgacttaataaagtcgtcgctgtttcagtatttaagtgcggtgcttttaataattgtggtaataacgtggttaactcgctagctgtcgcgccgactgcaattgcgagtgatttagcttggagtgccatgtgccctttttgaatcccgtctgaaacgagagctttcaaggccgctaaattttggcctaaaccgatggctgcaattacgccagccaattcttcggccgtttcgatgaccatcaagcgctgagcaacttgaactgtcggtaaaataccgattgaaccaccgacaatgccgactggtaatgggacggcaatttgaccgcgcagttgatggtcactagtccacgaccaatccgttaagggttgatagtgtccggtgcgtgcggcataactatgcgcaccggcttcaatcgcccgccagtcattaccggttgccataatcacagcatcaattccgttcataatacccttattgtgcgtcgtagctcgagccacgtcaaactgagcaaactgagtcgcgtcaatcagccgttgcgccactgcttcacccgttaaggtcgccgtcgctaaagtcgccggattaagcgtcactgatgctttaacaaccgacccaaaggcagcgttcgtcaaaacgctcagcaaaatagtcccacctaaagtcgcttgaacagcatgggcaatcgcctcacaaatggtatttacaatattagcacccatcgcagccttagtatcaatttcaagattcaatttcagaaaatgattttcaacgatcgtcgttgcaattttctgcaaaccaccaccacgtttaacaattgacggatgcgctttttgggcgaccgcttgcaaaacagtaaggtggttatccacccattttacagcatctgctagctgaggtaaatcagttaaaacaacttcaccaaacatcacccgtcggctactttcaattgtaacgccgccatttaggcgcgtcatcttcgcggcattattagccgcggcaatcactgatggctcttcgatggccattggtacctgataaaccttaccatctaccataacatcttgcacaatgcctaatggcaagtgatattgtccaatataattttcaatcatactatcggctaattcatctgctaacggttggctttgtgccaaaaattgtgcatccttttttgaaagttggctggcctcaaccaagcgggctaaccgttctgattttgaaagttgataaaactttggactagtcatctagtcatttagccacgcctcgtttagttggatttcataagcaatccctaagccgccaccaatacataacgaggcgaccccagttgtttggttggtccgttttaattggtgcaataaagttgtcataatccgtgtgcctgaagcgccaattggatgccctaaagcaatcgcaccaccggcaacgttcactttggcagtgtctaacgctaagccgttttgaacagcaacacttgaggctgcaaaagcttcattgatttcaaataaatcaatatcagcaaccgtttgatcttgtttagccaacaattgttggatggcaggtactggtgtgtagcccatgtaattaggatccatgccgacttcttgataaccaactaatgttgcttgataaacaaggccgagtgcttcggctttttctttagacatcacaatcattgccgatgcaccatcgttaatccctgaagcattagccgctgtaacggtgccgtctgcttggaaagcaggtcgtaattttcccattgcttcaagtgttgtatcaggacgaatgccttcatcttgactcacttcaaaagttgcccgtcgttgtttcacagttacagggacgatttcagcatcaaaccacccagcttgtgtcgcttgagctgccttttgatgtgattctaaggcgaatgtatcttgcatcaaacgtgtaatgccgtatttggcagccacattttcagccgtaattcccattggtttattggtgaaggcatcatttaaaccttcactactgatactatcgacaacggtttgatcaccaaacttgctgccaaaacgcattccgttattcaaataaggggcttgtgacatgctttcagtcccaccaactaaaacaacatcggcatcacccatcacaatcgcactttgtgcaagacggatggccttcaaaccagaaccacaaacttcattcacagtcattgcaacgctcgtttgtgctaaaccgctgtttaacgcgatctgacgcgccacgttttgccctgaaccagcttgtaagacattgccaaaaatagcttgatcaatttggtcagcttcaataccagctgcttgaatggctgctttagccgcgatagtccccaaatcgactgcggttaaactagctaattgcccgccaaacttcccaattggtgttcgtttggcactcataatgactacttctttcatatgcaaacaacatggttaacatcaacaattgcgttcgaattacaaaacgaggcctatgaagacgatcatctcatgcggcgtttaagcgcagtcaaagaaaacgtacaagccgacgaaattcaagcagttggcgaagcccttgccagtctgcatgacgacgatcaatttatcatggccgaactgacaaccaaatcagtttataacgctaagtaaatgaaagaacttaatttagaatttaaaaccagtgttaataagaacaaaacattacgcctacgccaagtcaacgaatccctaacccctgaagtggttaaagcagcaatgattaaaatcgccgacgctaatctcttcgaaaaagacgacatccaactctacaaaacaccagtcgcagccaagtacgttgaacgaattgaaacaccaattttttcagataaataaatgtcactttcaaacacactaatcattgactggcaacaactgttgattgccattatgcgcaactgcgcactattaattttaatgccactaggatttgccgccttattgacggtgattaaccgctcaacgaaaacgcgcttagcacgctggtggccccgctcacagattgtgattggtggcctaggcactattattcatgaattgagccacgcgttattttgtctgatattcaaccatcaaattactgatatgcaactactcaatcgcaacttaaacgatcctaatgaccattccctcgggcacgtcgaacatcgctaccgttctggccgtctgtggccaacaattggtaacttctggattggcctagcacctattttgggttgttcagccgcaatcttgggcctcacttggttactagcgcgcaatacgtttcaaacctggctgacgtttgccggagaaccaacttggcaatggcaggcaatcaaacccttattcagtcaactcttgatgactactaaaccgagcttcctatttatctggttgatcctctgtggcatgattgctatcggtggttttgacttatcaaaggctgactataaagggatgattcccgggattatcgcaaccctgatcgttattatcggggtcaccttcatcgccagcctattcaattccactactggtggcactagttggttactcaccatcctgacaccattaatggtcattttaacaatcgtcgtcttactctcattgattagttggctgattgtcgccgcactacttaaattgacgcaaaggagtcgatatcatgcgcgtcattgaatgcgcgtcattgatttattacaattactcgccgatacaccgcgcaacgcactcatttttttcgaaggctctgatcaaaattggccgattgccgactttgaacaagatatccacaatgaacaaccgcgtctgttattacaaacagttgccaagaagccacatcccctcaaacaatgggagttcagtctccttttgaaccatcgcgaatactatcaacactatgtctacgttaatcaagatgatcaagcttacccactatttggcttccgagttgcccaaaataaaattctgctcggataactacaggtcagccgccaaagcggttaaatactggtgactcgcaaccatttcccgcgcatcattttgatcagccagctgaacttcatagatgttcgttgctgccgaatttaaaaccggcacaacccggcgccaatcaatgcggccggtcccgagttctaacccatcatgtttaagtcctaacgaatccaccagatggtaatgggcaatcgctggttttagcgtctgtaagctctgaactaacacgtcattatcgccatggtacttaataaaacagtgactcgtatcaaaagctaaccgatagcctttcgctaaaatggcttggtccaaatctggattaccgtaataaaagagtggcgaaatcgaattttcgaagaatagatgatcatgaccaatcttgttaagatagtccatccgtttaaaaagcacctcagccgcttcagcgagattgcgataaccaactgtcaattgctcgactggttcatcatacgaaccgtggactaacaactgaacgttttccgcttgtgctagttgcaataagtccaacgttgactgccacaaaaagcgatagcgcgctggtgagctggcctcactcatcgataactcaagatgaccgccttcaaaattcatcggatggtgtaagataatgtgctgcaccccttggttacggataaattgaatcttatcgcgcagcctttttaaaccagcacttgcgacatcttcttccgtcagatgaaattcaaatacgctgggatgatattgtaaacgatccttaatttgacggtcattcacacccgcctttaaccctagttgcatatggatcgttatgccgttatttataatccgcattctggccaagatcatggcgagtcagttggtaaaaaaattgaacaagccctcgttaaaaaccagcagacggttgaattgatgcctactaaaggccctaaagatgcgacacgcttagcaaaaaaagcggcgcaagcgcagttcgatatcgtagtcgctgtcggtggtgatggcaccatcaacgaagtcgttagtggcctagctactttagagcagccaccttatttaggaattgttcccgctggtaccgttaataatttggcccgcgttttacaaattccgttagatattgaccaagcgattgaaaatctacagcaaggccatctccaaccactagatgtcggtcaaatcaatgatgactatctaatcagtacgatgacgcttggtattttagctgacgctgctttgaatgttacccagagcgagaaacaaaaatggggccccttggcttttttaaacgaaggtattcgtgtattagccaagcatcaacattaccctttaacaattgaaacccctcatcgtcactggcaaaaagacacacagttcttgctcgtgacactcaccaattccgtcggtggttttacaaaattcaatcccgaagcgcaaccagatgatggctatttccatgtatttgtcgctcctaaaatgtcattaatgcgctctgctatgtttctcccctattttctaacaggcaactttaagaaaattcctggaatgacctactttaaagctgataaaataacaattaccactgacaatcaagaaagtgtgcaaacacgcattgatggcgatcctagtaccaaatcaccgttaaatatgcggttattgcaacacaaattacaagtcatcacgcctcactagctatttcgtttcattttcttgataacgttgataaagtgattctaagaattgaatttcagttacattttgataagggagcacatagaaattagcgagaccgtatgtcacaccaaccaataattgccagaaataaaatgaatattgcatgattaagaattctaatttatagccatgcatgattttacgactcatgttaatcgcttcgctagcagtcatttcaggatttttttccaataagacattagtcattgcgtatgaggcccctttgacaactcccggaatgacgaataacaatgaccagcagaattgatagaaggtggttaaaacatttgcttttaacacccggttcttttgcgcttttactaagtagttaaaaattttcaacccatcggcacgctgacctcgtaaagtaacgattgcgcaccactgtaaaacgggtttgcgtaaacaagcaattaagaatagcactattaagagcataatcaccactacaaaccataagaaaaccgtaaatccggtcggaccttggtcagagtagaggttccccaaaattgtcatttcaatggccgtcatcattctgccaaaactcattaccaaaagaaatgtgacaacaatcatccccaccaccaaccacaagatggtcttcatccattcaccataacgccctgataatttacgttgggcttcctttttgatgtcagcccgcgtcatatttaacccctcgacttggtctaactggagtgccatttcttcatccgtttttaatttttcaaaacggctcttcatactgtcgcctgttgcgtttggattggtcatttgttcgatgttaaaaccacatttagggcaaaatttagccccctccttgatctccgaaccacaatttggacaaaacttcatttattgtctattgcgcgcgtattttgcttctaccttagctttatctgcttgccaccacgcttcatgatgacgataccagtcgattgtctgttgtaacccaactttaaaatctgttaattgcggttgccacccgagttcctcctggagtttggtcgcgtcaatggcataacgtaaatcatggcccggccgatcttgaacttgatcatatgcatctttggactgtcccatcaatgttaaaatcatttctaaaacagcttgattagtatgttgtccatcagcaccaatcaaataggtttcgcccattctgccccgtgtcaaaatcgtccaaacggcactagagtggtcatccgtatgaatccaatcacggatattttggccagcaccatataatttagggcgcctaccacttaaaatattggtaatctgacgcgggataaacttttcaatatgttgatacggcccataattatttgaacaattggatatcgttgcgcgtagcccaaatgagcgcacccacgcccgtactaacaaatcagaactcgccttggaagcggagtacggactactaggattataacgtgtttcgggtgtaaattttgcatcatctactaacggtaaatcgccgtaaacttcatctgtagaaacgtgatgataccgcacatgatattgtcgacaggcttcaattagcgtataggaacccataatattagtttgaataaaaggtgttggatcctgcagcgaattatcattatgactttcagctgcataatgtaccaccgcatccaccttttggactaactgctgaaccaatggtgcatcacaaatatcaccgactaccaacgtcactcgttctgctggtaagccggctaaattagcccgattaccagcgtacgttaacttatccaaaaccgttacatgggcttctggctgttgccggaccacatagcgaacaaaattagaaccgataaaaccggcaccaccggttacaagaatatgacgtatcatctaaacattcaataccttattcaagaagtccttcgttctatcgttttgtgggttgccgaagacatcgtctggggtgccttgttcgacaatgtgcccgtctgccatgaagatgacacgatcagccacttctttggcgaagcccatttcatgggtaacaacgaccatcgtcatcccttctttggccaagcgcttcattacttcaaggacgtcgccgaccatttctggatccagcgctgatgttggttcatcgaataacagaatatcgggtttcatcgccaaggcgcgcgcaatggcgacccgctgtttttgaccacctgaaagtgagcttggtttggcatcgtacttatcagataagccgactgtttccaaaagatgtttagccgtttctttagcttcttctggtgtcatcttgcccagttcaacaggtgctagtgtgatattttcagcaacggtgagatttttaaagaggttaaagtgttggaacaccatcccaattttttcccgaatctggttcaaatcgctcttacgatcactaagattataaccatcgacgatgatttcgccactcgttggttcttccaaacggttcaaacagcggagaaaagtactcttcccagaaccagaaggcccaatcataacaaccacttcattgttgccaacggttaaatccaaatccttcaaaacttcattactaccataatttttaatgaggtgggacacttcaattctattcatttagttattcattctcctctcgatatacttcgataaccatgtcaataatgtaatcacaatcaagtaaatcaacgcgatcatcccccagattttgaagccttctaggtttctagcaatgataatcttgccggcttgcgttaattcgacaatgccgataattgataagatcgaggtatccttcaatgtgatgatgaattggttaataaaagatggcaccataatccgaatgccttgtggtaagatgacgcgacgcattgctttgccatatggtaagcctaaactacgggctgcttccatttgaccagcgctaacggcaccaatcccacctttaacgaaggcggctgtataggccccttcattgaacatcagtgtaatcacaccagcgaccattgcgggaatcttttgccccgtcaaacttggaatccccgtgtagatgaataaggctaagactaatagtggcaagccccggaagatataaatcactgtatccgaaacggcccgtgcaaatttattcggtaacacgccgagtaagccgaagaagacaccgaagatggttgcgaagaagatcgcgatgaccgttaatagtaatgtttgacctaagccatctaagattgcgcccttattttcttttaataaaccgaagaaactgtgatcagcttctttttcgctagatgctttagtgtttaaatattttgcttgaattttagcgtattcgccactggcttttaacttcttcaagcccttgttgaatttagcgactaattctgggttcgtgcctttcttaacagcgaatccgtagtcgccgccttgaactggatttgtgacaattttcaagcccaaaccagtcttaattccgtattgcatgactggttcatcttcgaaacaggctactgagttaccgttgacaacatcattgtacatattgtcggaatcatcaaaagtaaccgttgtaaagccgtactctttggcctttgattttgcataatcaccagcagccgtcccagtcttaattgcgacccgttggcctttcaatccttttaagccagtaatcttactgtcttttttaaccgccatgacaacgcctgtgtgataataaggatccgcaaaatcaaattttgctttccgttcatccgtaattgtcatcccggcaatcacaccatcaatctgtcctgattggaccgcttgaacggcggcattaaagccgagaggttggatattcactttgaaaccttctgattttgcgatggccttcatgatatcaatatcaatcccgacatacttattatccttattcgcaaattcgaacggtggataagtgacatcagttccgatttcataagtcttctcagccgcttgcactgattgcacctgttgactgccaaatacaaacagtcccagtaacaacaaactactcaaaaataacgttattttcttcatttagccgagtttagcgacatccgccaatgcttcattaatttgatgacaataatctttttgaatttgtcggatctcctgtaatttttctaatattaacgaatcgttctctgtttcaatgattgataacattttttcaacactttcagcgtatcctctaaaagcttcctttaaccgttgattagtttcagtaaaataacttggcggattaatactttcagtcaattccacaaaatgtcgcaaattcaccaaattcttctggaaatacttcttcaaggaatgcagattctcattaaccaaacatctgcctaatacgatattacggcaggtttgtgtgtattcgttaaaaaccgtatcaaatactaataatttctcaacgacctggttgcagcgcatgatataagtaaccgacgataacgtttctgtttgacttaacatatgattaagccgattatgcatgataccgaatttttgagccaggtggccctacctgccacaactgcagatacagcagttatcaccgatttaattgatacattacaagctaacaccgatcgttgtgtcggcatggctgctaatatgattggcgttaataaacggattattatcgtccaaatggggattctccctgtaattatggtcaatcccaagattatccgtcacagcaacccttatcaaactgaagaagggtgcctatcacttgttggccaacgttcaacaaaacggtatgaaacaattgaagtaagctatcaagatcgccaatttaaagcacagcaacaagctttttctggctgggtagctcaaattatccaacatgaaatagatcattgtgagggcatcctcatttaaatgttaaatattgcattttgtgacgataatcagtgttttctaaaaaaaatcactcaagaaatcgatcgatcattagccatcaaagcaacttatcagacttttacaaatgcaaccgacctactcgatgcctttaaacccggtgtattcgacgccctttttatcgacatttatatgcccaaaattaatggtaaaatgttagcccacaaaattcgcaatcttgataagcgggtaaaaattatttttgtcacccgttatgaacaagaaattctaaataccctgcaatatgatatctatgattttctacctaaagatcatctcagtgagcgcattgataatttgctggcacggctgagtcgctctgtggcttttgaaaataacaaatatcttagactgaaactacgcgaaacaactggtgaagaactctataaaaaagtctatcttgatgacattatttacgttgaatcactcaatcggaaggtttatctccatctggccgatcaaacccaatttgaacttatcggttataccttccaagaaataacagattcgctagttgaaaagggatttctgagaacacatcggaaattctccgttaatccaatttttattaatgaaattaaaaacaccagcatcctaatggataatggtgaagaactagatttaagccgtcgacgaaaaaaagaagttcaagaagcatttatatgcggtatacgggggattctcagtgactaagtgactaatctaattatctacgttacaccgactgtgattgaagtgaccatcctttatgtactattgattttatttttaaatacgcgttttattcaacgaagccgggcgattgctgtgctaatcacactcattgcgatagattcataccttactatttttatctctgaatcaataccatatatccgtgcactgctaatccccatcgctgtcagcctttcatcaatattactatttaaagataaaataattaaaatcttttactttgttgcattaggttactattttgtttatttctctgatattttttctgggttaatactctccaaccttctcaataaaaatatcctacaagttatcgacgttacagatttttatggcatcctattctatattctgacgaagtcgatcatgttgcttctaatttatggctactaccactttttcaataaactgaatttaaatatctcatatcactatttgatgattatgaattgtattttaaccattggtgccatcctaattgaaaatttcatgtccatcatcagtggcaacttaccacttaacaatacgggcccgttatcccataaaatactaattatggttattttactcaatatcactatctgcttaacgatttacctattttcacaactaagcctctactatcaaaatcgtgaatttgaacttaaccttcaagcgacttctactgtcttaaaaaacgaaattaaaattcaaaataaaaaagaacttgaactcagtcatatgcagcatgactttaaagaaaacatcatatcaatcaaatacatgattgaaaatgagcttgatactgaagccattaactatgtcaaccagattacagggcaattggagaaagttaaagcccaggttttaaccggaaatgtctatattgatgccgttttaaacaacaatatccaactatgtgcttctaaggatatcgaactctcacttaaagtggaccaagtccagactgaatcgttagaacccgtttccctctccgacatactaattaacttattaaaaaatgccgttgccgcaaccgaaaagctgccccctgaaaaaagaaaaattagcgttaagatttttgaatacaaacacaaattggtattaatcgttaataactctcatgccgaaacccatttaggtagtaaggtaaacctttctaacaaaagttggtttaagcatgaacatcacggactaggtatcgggattattaagaagagtatcgatcgactagacggtgattataaaatagcctacgatgaaacgcactttgacatgcttgttttattacctatcgatcaaaaataattggaaaaccttacaaaaatgattactaatctactcgttagaaaaaaagtgatttcagcagacgaacaagtcttctacaattatggcgttgagctaacaattaatgagtttttgattacggcctccatcttattatttgggctcagcactcatcaattttggctcactgtcggttatgtgattctctttagaatcattcatacacaaaccggcggctatcactgtcggacctatttaaattgttatctgacatccgcttctctggctattgttgccatctatctcgcgcaatggctattattcaataccactatcgcgattattttctcgcttctatcagcccttgctttctggtttggaacaccacttatagaagataaacgtgttaaaaatgaaaagtttaagcgtaatcggatcacgattatcgttttcggtttattctcagttttgtgtctgttcttccattttttagtcgttccaatcggtgccgcgacactggcaactttagtactagtcacaatatctcatttaaaggaggtgatatttcatgaaaaaagtcctaaattacgttagatgaaaaaagtcctaaattacgttagagaagccatcgtattaaagatgcgcttaaactcaaaaactgtttctgcaggctggagctacgaagttaaaaaaccagctgaattagacaaataccttaagagtattgactaactatttattttctttcttttcgctttgttttaatttttcacccaatttgataatatatttcttcaaatcatctttgacttctgggtgtttcaaaccgtattcaatacttgtttctaagtaaccgaacttgttaccaacatcgtaacgacggcccttgaattcgtgggcgaagacgcgttgtgtcttgttcaattcgtcgatagcatctgttaattgaatttcgccaccaaggcctggtttttgattttctaggacatcaaaaatttccggtgttaataagtaacgaccgataatggctaaatcactaggtgccttatcaacatctggcttttcaacgaagttcttaacattgtataaatcatctttaaccttgttttcagggttaatgacaccatacttatcaacttcgttatgtggtactttcataacagccaattgtgaggcatgtgtttcttcatattcgttaattaattgtttgctcaatggcacttcatcttccatcaagtcatcacctaacatgacaacgaaaggttcgtcagccacgaaagacttcgcaagacgaacagcatcccctaaaccattaggatgtgattggcgaatgaaatagaggttaacgcccatatcggttgtttcattaaccatcttcaacatcttcgtcttgttcttagcttttaagttttgttccagttcaggtgctgaatcgaagtgatcttcgattggccgtttgcctttaccagtaataattaaaatatcttcgatacctgaagcttttgcttcttcaacgataaattggatcgttggtttatcaacaattggcaacatttctttagccattgctttagtggctggtaagaaacgtgttcctaggccagctgctggaataactgctttgcgtactttcatatgttactactacatacgcgtaccgtcccgctccaacacacagtttgtccagattgcctacctttaatcaaaaccgtcgattatgatctgcgcttttgtgaatcaattagttgcccgtatatcaaccattatcgtattaattccgataccatgttgctagcgactaataaacatcgcagtttaattatcagtcgtaacaacggcctgcaagcgacgcccctttcaacccgcaaattaatgcgccagtataaccgtcaacaactcattgatttctcacaaatgcgacacatctatcataacttcggccacctacggaaactaccgcaaattaacggtgaataccaatttctaccgcttagtggcactgcccatcaaaacgcgagttggttagcgctacactacgttaaatactacgaacaagctggtgatcatctgcggattactttcctgaatgaaacaagttgcgaactcctctacaaaggacgtcagttagagaccgaaattcatcaatgtgccgcaatcggccggattctacgcacgagcctcgggatttgcgcaactaacttcggctataccatcgaactgcaatcctgttttaacagcagtatcatccacagctatgactactgttgttgccaattatgcagtatggtgcccgataatccgcaacaattgattcgactcttagatgacttagaagttcataaatcaaactacatctaccaagcagccattcaggaatataaggaatatccgattcatgaatttagctggtatttacaaggtgtgccaggctttattcgaaaattacgcgatttataaatgaccaaatctaaccaagccgctttcaaccgcttactccaagacgacaactttatttacggcgcccttaaatcgctccatattaatcgttatcacgagaatttcgatgatctctaccaagaagccattctaacctttatcgacgcctatcagcgctttccaggcgatcctgagacccatgagcacgaattcatcgtctacgcctaccaagcaattaaatgggccacgatgcggcacttcagacaagaaaacggccggaacaaacaaatcggcttcgttaaccgactatctgaagacgatgctttaatggactacctcgatcagatcagtgatccccgctgtgacccagataacgccgtcatctataacgacctcttcgaaaaactctaccaggtctgtgactcacgtgaacgacgctttctaatcctacgctactttgccaacgccagcctaaaagaaatcgccgcggacttaaacatcacacggcgaacagctaataatattaaatttagggtgcagaaaaagtttagtaaattgttaatctaactactctttattatcctttgaaatcgctgcccgcaactgtgtactgcttgttgattttgtatatgggaaataaataatttcaacatcatcaagttgactaaattcttcttcatatcgtttaaatctctcagtccctttataatctgaacctacaaataataagttatatggaatgatatttcgaacctcattatcttctggtaaagagacgattacttcatcaacatattttatacttcgaacaatttccattctttcttccaaggggacaaatactgttttatttttatgactagcatctttgtgcacaccaaccactaaataatcacaatactgctttgcctttttcaaaatatttaaatgtcctacatgaaataaatcaaacgtcccactcatatagccaatcttaatttgtggtttttccgtcacacgattgttgtcaaccttataatcatagctattaataccaaactcatgtggatcatttctgtttctatcaataacttgcttgtaggtttcctcgtaattaggaatcaataattgctttctttcttctagtgccgcaattatttctatggctaccttttgagccggttttatatcgatctcctgattatttgcaaagcgagttcctgcgatatgtccaggccttacatctaaaattctattattagagccatttttttctaactcaatatttagactttgaattaaagcactcaccgccgctttagaagcaccatacacagaaaatagtggtgaattaatcatacctgcaatactactgataacagctaccttaaaatcatctgaactttgaatttttgaataaaattgtttaagaatttttgtgacaatcttataattaatatcaatttccatattaacttctttttctgaaagattatcaaacttagcaactcttccagcaccaactgtgatgaataaggcatctatattactaaattgcttaaaataactagagtcatttactaatagattctgtgcaaagaatttaatttttgagtttattatctcgttatgcaacgttctaccgataatataaatattttcaacttgttcattagcaactaattcatttgcaagcgcccatcctaagccacttgttcccccaactattaaaatatttttcatctagcccttttttttcatatactctaaaattttaggctttgttatccatagtaccccgctataaactaccataccaataagaacctgaatcaccagttgaatcatactgaaccgcaaattcaaattcagtgttagtacaacgataaacatcattattccactcaataaatacttccaggtctcactcatcattttacttaaatttaacttttctttaactatatatatctgatagctcataacgctaaattcagaaataactgtagctatcattgcaccagacgttcccaataacattattaatggaacatttagaataatattaacaattgctccaactgttacagagatagtaaattctttattgtgccccgtaggcagtaagtactggacacccaaaacattactccaagcaataaacaatattaccaaagattcaatcatcattaatgggcctaccgcatcaaatgcttgtccaaaaaacatcgtagcaaatttaggcgcgatggcagcaactccaaacatcatcggaattgaaacagcactcacaaaatcaaacgattggtataagtactttttaacctgttcatgatcacctttagcaaacgtattagccactcgtggtaacattaccgtgcccgtcgctgttacaattgccaagaccatcttaacaattttatcagaattatcgtagaagcctgctgcctcaacagataccatcttcccaaccattgtcttattaaggattaaataaacttgcgtcgcaatttgtggtacaaataaaactagagaaggtttgaaatggtgccagatttgtaattctcgccaattgggtaaatcaatataccgttttaaataagggaataatgtaatattaccgaccaattgtgaaaccgataaaacagcgatatacaaagttaaatcccccttgccccgaacaaatataaaaatacaggccaatgacattaacttaacaatcatattccgtaataccgttaccttaaaattttcatatcccataaagaaccatgaaatatcaaaagctgcggcaacgattaaaatcgcttgcattagatatgcttggtgataagatttctcgaaccctaaaaagacaaaaaatgctgctaatgctactaaaatcgtaatcattctcattagaaaaacttcccaaaaaatttgagaagttttcgctttatcatctcgataataagcaatctggcgattaccatacaatgaaacaccaatactaccaattagaataaaatactgcgtatttgaattagtaaatgaattaatcccaacacccgttgggcctaaaacacgggcaatgtagggcatcgttattaatggtactaatagtacgaagacctgatagaacacattataaagataatttttgataattttcatttagtcctttaattcatctttcacaacttgtaaggctgcatgaatcacttgatgcatatcataataacgatattgccctaaacgaccgccaaagacaaccttaggttctgtttctgcaaggtcacgataagatttgtataaacgattatttttatcattattgattgggtaatatggttcgtcaccacgtgaccagtttgctgggtattccttagtgacgatggttttgtttttgtcacctttaccgaattcaaaatgcttgtgttcaataatgcgtgtgtaaggtgtttcagcgtctgtgtagttaacaactgcattcccttgatagttatcaacatctttttcttctgtttcgaaacgtagactacggtattctaattcccctaattgataatcgaagaattgatcaatcatccctgtaaagataaccttgtcgtattgatcgatgtattcttgttttttatcgaagaaatcaacacccgtttcaacctcgattaaatcgttatctaacattttttcaatgatttgtgtataaccaccaactggaattccttgataagtatcgttgaaatagttgttatcataggttaaacggaccggtaaacggcgaataatgaacgctggtaagtcggtagctttttgaccccattgcttttcagtatagcctttgattaatttttgatagatatctgtcccaattaatgaaatggcttgttcttctaagttttcaggttccttatcacctaacacttgacgttgttcagcaattttagcggcagcttcatcaggtgttacaacaccccatagcttactgaaagtattcatattgaatggtaaattgtagatttcacccttatagttagccactgggctattcgtataacgattgaattcagcaaattgattgatgtattcccagatttccttgttacttgtatggaaaatatgcgcaccatattgatgcacttggataccatcaacttctttggtatagatatttcctgcgatatgatcgcgtttttcaatcaccttaacgtgattaccgcgttttgcagcttcgtatgcgaaggttgcgccaaaaaggccagaacccactactaaataattagtcatttagtcatttaatttctcctttttattaaaaatagaaaatcctattaatataaatgggttatagaataattccaaaaaatgttggtcaatcatactactcatcgtgacacataaaaaacacaaaaggaatattcttttatactcaatatctgctttttttaaagatattgttagcagaattattaaatagacagtaaacactattccgaaagacaataatgaatttacgaaagaagaatcgataaaaaagtatttaaataacatatcaagtctccctgtaccaccccagccgtgctgctcaatataatttccaaaaagcctaatgggatactcattaaatgccatgttaccgtaatataatcttccagataatagtttatctaaagttactaatatactactagaattataataataagttattgtattcgcaattattgctcctagtaatggtgctaaataaattttatctattaaagagtttatatattcttcatccaataaattatataaatagaaaataaccccaatagcaaagattaatactgcatccaatctagcatcagttaattccaatactatatatcctaaaatcatatatatcgaaaaaataaaaaaatttgctctgcctttaattaaatacatgtaccctaataaaacataaaatacatgagcagcaaagtctgtaggatatttagttccaaaagagttccgtgtctttaagcctcttaaatacgtataatttggaataatacccttgtatgataaaagaccagctgttaataataatacagtcatttctattacataaattctgatgattcctctaatagggacgttgtatgcacctatcataaacattgccaatatatataaattattcttagctacataagaagcaacaatcgttataattacaaaaaacgtaccatatattatcaagggaactgttaatttatcaaagaatatcaatttaaacaaaattaggctcgcacacaatagatatataattaattttaaactactcgtattattaaattctattgttgttgagatcaaaaattgataaccaatatatatggaaaaagaaatgtaatataacacattagctatatttcctttgctataagttaattccatctaatccaaaatttttgaaataaccgattcagtgaacccgccattagttaccctattctgaaatttattaacattagccttataattatcatactcaagctgagtaatattgctaattactttattagcctcttctatactaccaacggatattcctattttcgttctatctacaagttcacttaatgctgatttattccatacaattaacggcattccactcgctaaatacaaagatgctttatgtggattgttatatcttgtatatgcatctgattcatttacagaatccccatcccatactagtccaaatccattctcacatgctaaatcaattagcaacttttctggagaccgtacccctaagtaattaaaatctccctggccgtctatcctattaattccatacaaatagtaattattgttcacagctttattataaataaatttagatttacctaagttaccagcaaagaaaattcttttatagttattattcttctccacatttaaactactattcgtcatgtagtcgaataaacctaattctagaatctttgatgtacaaccgttatcttttagccatcctgacattctagtattatgtgtgactacaaacttaaatttatttaaatttgatatctcacgtttaacaagtttcttacttgcgttttcccttaatgttggtaaatcatgaattaatactatagtattgtcaaatttactagttatttcatcaataacttgtgcagtaactctagtacctaagtaaaaaggatattgtacgagaaagtaactttctcgtggaagatcctgaagttttctactaaggttactctttgtaaaaatctctcgctccaatctactctgttgaccgtcaatataaatatttaaaaaatccattttggaaaggatctcactaatatccctaacggccttactccccgcatgatttgcatcagattgcatcatggtcaacataaatctattcatctaaaatttagcattttcgcttacaactttatccttgataacagaaataggggaacttaaagtattatacttatcaaccactttaggactcttagaatttttttgtaaaagctcatttactaattcactaatttctatagaacagttaaacccgctattcttgggatcgaagtatagccccctataatctttatattttgaataatcatacatatataagaaaattggcttctccaataacagataatcaaaaataatacttgaataatcagataccaagacatccgatcctatcattaaatcatttaaattactataggccgatacatccacaacagaattactagtcatattatcagatgcaaaataatgtcccctcactaaaacgttatatttcttttgaatttttgccagtgagtctctttcaaaaaaacgattgctctctgtagaaatgtttaaatcatattctctaaaagttggtgcatacaataatatctctttgctcggatctaaatttaattcctccaacagattcttctttatagaataactattactagcatcgtgaactagagattcatttctaggtagacccacattttgaatgttatcagtattttcaaatatctttgagaatatttttttatcatattcaccagaacacacaagtaaattaaatttaacttttttataccaattttttacagtatatgacaaattatcctcatcaggtccaagatgctttaaagggactccgtgccacgtattaatataaatatgtttatcactatttattggaataagtcgttcaatgcttgaattagaaacccaatattttgatttgaataacgcggtaaaaaatgaaaaactatcaatattaactctctcatcaattggaatttcggggaattcttctatattttttaatccccaaataaatttataatccttaaatctaggatcatctttcattgatatataaatagcttttgggctgtcactaaactgtcttcctgaataacttgtaaatattatttgtttctcatatggtctaatacatttatcaagtatcttataaaaaaacgacataaattgtacagttaaccaacctagtaatttattttctttaacaaaattttttattatacttttcattcataaatgtttaataccttcattttttttaatttcctttaaaaattcagttagtcttacgaaataattttcttctaaaaacttagttgcagtatttttaaccgtatttttttgatatttatatttatttttatcagctataattaatttattaactaagcttttaatgtttccaacttcatataaatatccgtttctctcatcaataatatcctctggaccagttggacaattagcagctatacagggaagccctctttctatggcctctatcaggaccattggcaatccttcatacttcgaagttaataataaataatcaacattcgtgatctgtttccaaggatcacgaagccaaccgcaaaaatcgattttattcttaatacctagttctttagctaaattttgagcattctgcatttgatttccatcaccaactaattttaaatgccatgaaatcttcaatctacttaacgctagaaacaattccctaagatttttctgtccgtctagcataactcttcccatatacaataactcaagtgtatctgatttagaactagaaatactctcatctgttttttctacgggattatagattaattctatcttatttgaagaaattccttctctaactagctggtgcttaatgcctgaactaattgccaagtgataatccgcttttttaatatccttaatcctaacagcatcttcgtgatctattgaaaaatgaatccatgaaacgagtagaaaattttttttcaatacttttctataaatactaataattctaacaagtctagaactcattccaattactatatctgtatctcttgtatgaaaaattaaataatttattaaatagaacagaccccataaatttctgaataattttatttttaacttagaatcgttatatagaatattattagtaatgtcactaatccattctttacgaatagtcccttgtggtattaccaatctaacttctatttcttgatttttactataaaactcaactacctttttagctactgtttccattccaccttgtcctgaaagataaggaaccagtatatcaactttcattttcattcaactttcattttcattattgattctcctatatacggattgaagcttttctacggaatccataatatcaaacccactatcactcatatacttatactcagattttctttcataatcaatatctgcatttataatttctgcccagtattttgccccttcttctaaaggtaccacccgcgttaattcataaataataacagcatcaggaattttatttgtagttatagaatggagtcccgctgcctctgcttcagcgagtacaagtccatatccttcattctgagatggaaagacaaaataatccattgcttgtagaacgtcaggaacgttgtttattatccccataaaaataacagcattattcaaagatttatttttttcaattctcttctctaactccgtcctcattggtccatctccagctattagcagaatagcattattatttaattttttatattcctcaaatacatcaactaagtagtgcggatttttcaactcacgcaatgcaccaacaaaacctaaaacaactgtatctaattctatccccatgctcttcctaatatttaatctagtttctgttgaataattatatttctctagatctattccattagttattatttctacatccttactttttccaaacatccagattgcagctttttccgaagtagcgatcttaccatctgcactataattaaaaacaattcttcctaaactattcaatatatttaaaatacttaatttaagtttgctattagttgtattagagtaataagaactatgtgaatgtatcacaattttggttcttaacattattcttgctagaataaccgggaaaaaattccatgatgaagaataattaaagtgaattacatcgtattgctttcttttacatatctttaagacatgtatccaatcaataagatgcttaagtattgaatcatgtacagaagtaaccttataatttccccacgataaacttttaagtttctggtttaaatcatccttacctccatacctaattacatctattctaaatttgtcatctaatctggtaaatgtttcgaaaatatattctgttaaaccacttttgggcctaaaatcaccaactactaataacttcttctcttttcgcacctagaacaacttcctttttaagaacgagccacctttaacaagccaattttgtttttccataaatttaaatggtacttcaatcaacctaggctgattaacttctaaccaaacatcaagtaacaactcactaataaagccataaactctagcttcatatgtatcatatttagagatatctaatctttcttcaacttttcctaagatatcaaacatccattcagagtattgatcaaaatatatttttttcattacaaacatattaaacatatgtgccgatgtactacccatgaccttttcatatgcttctaaatattccggataatcacgcacgataattgtctttgtaagttctaacggttctttatgatgcgcatggatatagtgagaataattactttcaatgtaataattcctttttttaggcaaaattacatcgtaattatttaataagctttcgaaatcagatgttgataagatttgactaaatccatttccatttttagtcttattaacaagatatcttctgtaatgaaccagacctatcgcatctacatctagatttttccatgcccaataaattgcagttaattcattataatttttatttttcaatgatatattttcgccgtcaccatcgccttgaaaaccaggattattctctgggtggatggcattaccaacaaatattggcaagtacgtctcatcttcaggcattttataatctttatgtgttgctaccaaaactttaatattcaattaaaaagcaccatcgtgtttaaaaatactaataatatttttaaacataatcttaatgtcgaatcctaaggatgcgtgttcgacatagtatagttcaatttcacagcgttctggatattctatattacttctaccacttgcttgccagtagcccattgcacctggtgtaacggataagagcttatcaattctttccttcgttccatactctgtcaattctttttctactataggccgtgggccaataatactcatattaccaataaaaatgttgataaactgtggtagttcatctaatgacgttctacgaataaaccgaccaaactttgtcactcttggatcttctccatctggtaatttatagctattagcaacatatttttcatatagttccttattagctaataatttcttatctgcatttactaccattgatctgaatttatacattttaaataactcgccattacggcctacacgcacttgtctgtagaataatggtcccttattttccccaattaaatagattactgagaacacgataaaaaccggaataagtatgatcaacattactccggaaattaaaatatcaaaaagacgtttaaagaatcgatataaaataccctgtgaggttgtctttttgacttcgattgtattaaccaatctttcacctattattttatctcgatttagttcagtattatctgccatctatttttcttctttagtaccatagtagccaccgtaataaccaccataataaccacctgtattttcaggcttcactcgattcataattgtccctaagattcgtgcgtgaactacatctaacaattccttagatttaataaccgaacgtttatcggcaatgccttgtggtgccactaagattgtgccctcaactttgcttgctaaaatttgtgcatcggttactgaaattacgggcggtgcatcaaaaatgacaagatcaaagtgttttgtcaattcaacaattaacttatccatcttcttcgtatttaataattcagatggattaggtggtactaccccacaaggcaaaacaaacaaatgttcaaccggtgttttttgaatcgtcgtgttaaaatcaaattcatcttctgttaatagtgatgttaagccttttttgttaggcacctggaaggtttgatgaattgttggacggcgcatgtccgcatcaactaacaatacattaaccccttgatcggcccaagtaactgccacattggcactaattgttgatttgccttgtgaaggaccagaagacgtaaaaaccagacttcttagtttttgatcaattgacgagaattggatattcgtccgaatggttcggaattgttcagcaatcactgaagttggtgaggttaaagtaattaaccccaccccttctttcatactatcttgatctaatttcttttcttttctaaataatcccatttaccctcttctcgataaagtacttgttctcataatggctttcttaattaaatctttcggtgcaatattattaacaacacctaaactcgttagtcctaattcttctgttaagaaactttcatctttaactgttttatccattaattctcgaataaatgcaattcctatcccaactatcagtcctaaagctacacctattaaaatattcaatttttttcgcggtgaaactggtgttaaatcgggcttagcttttgaaataattgaaacattatctgtcccactcataatcttaggtgctttcttttggaaagttgtagctgtcatattggcgatatctgctgccgtatatgcattatcagcttttgcagttactgagaaaacttgtgaattttgattatttgaaatactaatcatcgaggcaattttatcgttatctaatttggtagacttgccatcgttgatttttttggcaactgagtccataatcaccggcttcgtgattaaatctttataggtattaatcatctggacatcggtttgaacttgattccactgtgcaccagcatcagtactttgtttacgattaactagtaattctgtagaagcactgtattgtggcgtaatcacaaaaaacgttaaaatgcctgctaatagtgtaaaaatcactgtcgataagacaataagccgactgtatttccgtaaaataccgaagatctgttcaatattaattgtttgttccatttacttcaaatctaattgctttctgagtagtgttgacatgtttgaaacttcatccggtgacatcacttggaaagattgaccatcaatcatctgcccggttcctttcaattgttttgtcttaaagttcattgcatccccataattgcgttgaatgttcaagacatcctttaaggtcatattggtttgcatgttattttctaaaatctgtaagaacttattatattgggtcactaagttcaatgaggtggccttcttcaaaactgcttgaatgattgcttgttgtcgcagttggcgaccaaaatccccacggggatcatcataacgcatccgtgagaatttcaacgcggtctcaccgtctaatgtcaccgaacccttttcgaagtggtgaccttcataagtgaagtccaagtcattatcaaccgtgacccccccgactgcatcaaccaattgttctaagcccttcatattcattaagacataataatcaaccggtacattcaaaaatgattgtacggtattaatagccattggaatcccaccatatgagtatgcggcattgattttcgccttttgtccgtacccagtaatggtgacccgagaatcacgcgcaatacttagcatattggtctgtttcgtctgcggattgacggttgctagaatcatcgtatccgtccgccctttttctgtgcgacctaactcaccagtatctgttcctaataataaaattgaaaatggcgtttttttgttgagtttaaccgcttgattagccttacgtttattctgtgttttacctttagccttgtaaaccgtcttcgccgtttgatcaacatcatagtagaccttcgcagcaaaagcaccgcccgccaaaaccaagatacctaagaccagtagaataattttccatggggtccatgttttcttatggtgtttatggtgatgatgacgatgtagttctggttcatctgaattcatttatgactcgttttgctccttacggcgttcgatgaaatcgtggacttttccctgactaacgtcgacttggccggatcccgcttcttcaattgccacgttgacaacagcgccaaacattaaaaccattgccgaataattaagccacaataatagaattataaaagccccaattgtcccataactattccaagaagtcccaaaataccgcatgtataatgagaaggcttgcgctaatattaaccagccgaccgtcgttaagaaggcccctggtaatacgctgcgcagttgcatcttaacattggggacaaagaaataaacaaaaatcagaattacgaataagacaatgctagtaatcggccattttaattgtccgaaaacattaatgtaatcttccggtattttgaagattggtgttataaattctagaaattgttgtccgaatgtaaaaacgacgatcaaactgactaataatagtagtaagactaatgtggttcctagagaaatgaggcgttttagaataaaattctgaattttatcgactcgatacgcccgattaatactaattttcaaggcgttgatgcccttactagctgcccacaaagttcctaaaatcccgacggatagcaaaccgctatttcgtttgttcaatagcgattgtagtatcggcataatccgattgaaaatcgtcgggggcacagccgattttacataatcagccacgctgagcacatctaattgaaaataaggcaagatattcccgataacaattagcagtggaaagaatgataacagtgcgtaataggcaattatcttggcgttatcgctgatattggcctctgatgatcgccgaatcatcagtttaatgaaggcaatcaatttctgctttccggaaatatcccgtttaaaaaccggtaattgattttgttcgtctgatttcatttataataaatattttgcatccatttctggatcttgtgatgttaagattttagggccgtcttttgtgatggcaattgtgtgttcgtattgcgcacaggctgtgccgtctgctgagacgtagtattcccaatcgtcaccagggactgtcttagccttgatgtgccatgtgccacctaagatgaccattggttcgattgtaatggtcatcccttctttaagacgcaatcccttacctgcttcaccgtacgaagggacgttaggttgttcgtgcattgttggttggataccgtgaccgattaattcacgaacatcaccgtagttgttttcaacttcggtatattgttggatggcatggccgatatcacctaggcgattgccgacaacggcttgatcaatgcctaagtaaagtgctttgcgcgtatcgtccattaatttttgtaattctggtgcgatttcgccaaccgcataagtccagcaagaatcactttcataaccgtctaagttaacagtcatatcaacagtgacgatatcgccttcttttaaaattaggtttttacgaggaacagcatgtgctacttcgtcgttaacacagacacaagtggcatacttataaccttcaaaacctttttcagatgccttagcaccttgtttttcgatatagtcatttgcaaattcttcgataacccagcttgaaataccaggtttgataatatcgcgcaaaccacgatgaacaccggcaatgacagcacccgaagctgccatacctttaatttctcgttcagattttaatgtaatcaaatggcaacagcaaaagtagtttacgcaagtatgaccggtaataacgaggaaattgccgatatcgttgaagaagctctcgaaaacttagacgtctcggttgaaacgtcagaaatctcacaagcagatccttctgattttgaagacacagacatctgcatcgtctgcagctacacttatggcgacgacggtgacttaccagacgaagccgttgacttctatgaagatttaaaagaaatggatttaacaggtaaggtttacggcgtctgtggttcaggcgataccttctatgatgaattctgtaaagtagtcgacgatttcgccggcgtcttcgaacaaaccggtgccaccaaaggctcagacgtggttaaagttgatctcgcaccagaagcagaagacattgaacacttagaaaaattcgtagcagaaatagtagcaaaacagagtgctctctaaatggcttttattaagcggctattatttaaataccgagatttattgacctacaccgtttttggctttctagcatcgctcgtcaatatcttcacttactggatctttcgccataccatcatttggccttacttgttagcaaacacgattgcttggttactggcgaatttatttggctttttcaccaataagtccttagtgttccaatctaaatacacaactttcaaggcgctctttcgcgaagtgatttcctttttcttcttccgtggcgtttcctttttcttagataacggtctgatgattgttgccatctcatttctagggtggcagagtatgacagccaagattgtcgatcaattaatcgtcggtatcgtcaattacattacgacaagctacaccttcaagaaaagtgagcggcagatggccttacgcggtcgtattctgcgccattatcatactattttaaaacgaggcgatcatgattaaatgattaaaacaattcaaaatctcattcataaatattgggaacaattaatgtatatagtcttcggggtattaacaaccgccgtcaatatggttgttttctaccttttagaccagtatactggtatgtattacttactcagtaataccattgcttggtttttatcagttctatttgcctttttcactaataaaacctgggtttttcagtcaaaatacacgacttttagagatttttcacgtgaaatagctagtttctttttcttccgtggtatatcctatataatggatactgcgataatgtttgtcgggatttcaatgctccatggtcctaacatggtggttaagattatcgatcaatttgtgattatcctggtaaactacattttcagtaaatggattttcaataagtcaacggaggcttaaatgagcaaaacgatttcaattattgtcccctgttttaatgaacaagaatcagtcccactattttatgcagcagttgaaaaagttgcggctcaattaccagatcatgctatcgaatacttatttattaacgatggttccgctgatcaaacgctaccagcaatgcggacattacaagcacaagatccagaacacgtgcattacatctcattttcgagaaacttcggtaaagaagcggcgttatacgccggtttacaagctgcaactggtgattacgtcgccgtaatggatgtcgatctccaagatccccctgctttattacctgaaatgattcaaggtatcgaagttgagggttacgattgtgttggcactcgccggacaactcgtgctggcgaaccacccgttcgttcattcttcgctaaaaagttctatcaaattatcaatcatatttctcaaactaaaattgtggacggtgcgcgtgattaccgtttaatgacccgtcaaatggtcgatgccattcttgaaatgactgaatacaatcgtttttcaaaaggtatcttcagttgggttggtttcgacactaaatatcttgaatatcaaaatcaagatcgcgtcgctggcacaacaagctggtctttctggggactcttcaagtactcacttgatgggattgtcactttctcagaaacaccgctagcaattgcctcatttatcggtttcttctcgtttattatcgcgtcaatcgcgctaatcttcatcattgtccgtgcgattatcttcggtgatccaacaagcggttggccatctctcatctcagttgctctaatgattggtggcttacaactcctttgtttagggattgtcggtaaatacatcggtaagatttatctagaagttaagaaccgcccagtctacattgttaaagaaaagaaataattaaaattcttctggtcgttccttcgtttgttcgaaatgatacgcaattgcgtctaaaatccgctttgaagcaaagccgtcaccgtatgggtttttagcttgcgccatggcatcataaacttcttggttgtctaacaactcaaccattgcatcgtgtaccatttcaggttgtgtgcccactaacttcaaggtcccagcttcaacaccttctggacgttcagttgtgtctctaagcaccaagactggtttaccaagtgatggtgcttcttcttgcacaccacctgaatcagacatgatgaagaaacttctagcggctaagttatggaagtcaaccacatctagtggatcaatcaaatgaatccgtggatggttacctaatatgctttgcgctgcttcttgcacaactgggttaagatgaaccggatagacgatttcaacgtcatcatggctctcaaccacttgacgcatgactttgaagacccgcttcattggttcgccttggttttcacgacgatgcattgtcactagaaccatgcgtttatcagcatccaccacgttcaaaatatcgtgatcatagtcgctttgcaccgtttgtttaagcgcatcaatcgcagtattcccagtaatgaagatattatcttcgttatggttttcttgtaataagttggctttactttgacttgttggtgcaaaataaagatcacttaaaacatcggttaattgacgattcatttcttctgggaatggtgaatacttgtcccaagttctaaggcctgcttcaacgtgcccaatggccgtttgattatagaaggcactgatactagctgcaaacgtggtggtggtatcaccatgcactaagacaatatcaggtttttcagtggcaatcacgtgatcgagattcatcaagacgttacttgtaatctcactcaaggtttgacgctgtttcatgacatctaaatcataatctggtttaattttaaaaatttcaagcacttgatcaagcatctgacgatgttgagcagtgacaacagtgaccgcttcaaactctgtatcacgctttttaagttccaatacgagtggcgccatcttaatggcttctggtcgggtaccaaaaacggtcattactttaattttagacacttagacccgttccagttcaaaacaacgcattagcatcacaccgatttgcgttgaggctgattcttcatcaaattgcactaggtgcgcgttgattaacgtggcaaagcccgtcattgtaatccaaatttcattgactacttgttgttgctgttcttttgtcagacgttggagtggctgataatcatggagccgaatatccgtcacttgattaacaaaagcgcgtgtttcagcagcaccaaaatgattatcaataaataacgcccggtagagttcaggttcaaccgtcgcaaaacgaatatagcccacacctaagttctcaagtgcgtcgtcatgatgctgttcttcactgacataccaaatcaaacgcgccttagcttgttccaagacagcctgtttcaattctgacatactcccgaattcaagataaatcggctgtgttgagcaattcaaagcggttgctaatttacgcgctgtgattgatttcaacccatccgtcaaaacaatttcgtatgctttatcgagaatttgttctgcttttattctttttttacgtgccatatgacgactttccaacataatcttgaaaaatacgcagcattaatcgctaaaacggggattaacgtccaagatggcgataccgttatcatccaaattgcagttagccaagctgaatttgctcgcgacattacggcagcttgttacgatttaggggctgctgaagtgattatcaagtggcaagatgatgccattgatcgcatcaacatgcaacacaaggcgcaagaacgtttgattgacgtgccagacttccaaaaacaagaatacgattactggttagcaaacgacgctaagcggatttcggtgatgtctagtgaccccgacaatttgaagggcttagatggcgaccgggttgctgctgcccaacttgccaatggcaaagcaatgctcaaggtccgccaagccacacaagccaacaagaatagttggatcgttgtagcagctgctagtcctgcctgggcgcataaagtcttccctgatttagaagcccaagaagcaactgataaattatggactgaaatcttcaaaacaacccgtgttgaccaaccagatccaattttagcctgggaagaacacggcaagaaattacaagctaaagcagccgaattaaacgctgcccaattcaaagcccttcactatactgcccctggcactgatttaacaatcggcttacctgaaaaccacatttggattggtggtcctaaccaaagtagtgatggtcgcccattcgttgccaacatgccaaccgaagaagtcttctcagcagctgatgccaaccatattgatggttatatctcatcaactaaaccattgagctatgctggtaacactttgaataacatgcaattcaccttcgaaaacggtcgcgtgattaaagccactgctgaagaaggcaacgatgttcttcaaaaactattacaaacggacgaaggcgttaaaagtttaggagaagtcgccttagtaccagatccttcaccaatctcacaatcaaagatcaccttctacaatacgttattcgacgaaaatgcgtcaaatcatttggctctagggtcagcttacgccttttcaattgaaggtggcactgacatgacgcaagaagaattaaaagcagctggcttaaatcgtagccaagcacacgttgatttcatggttggttcaagtgatatgaacatcgatggtttaacacatgatggtcaaatcgtaccagtcttcagaaacggtgactgggctaactaaatgctaactttttggcttatgctgttaggcatttcgatttgcctaacaaccttttttgtcggtttaaccgcttattactattttcaaaaacaagccactaagttattagtggtcatctcgttaattgggattgtctgtacagtcgtcacttattactacttccaccaagccctgttaataccagctttataaatgaaagctatcacaaccaccaacgcgcaaccactagaacatcactttcatctatcagaacgactcaacatcattcgggccggtgttctaggtgccaatgacggcattatttcggttgctgggattgtggtcggtgttgctagcgcgcaccaaagtcaatacaccctcttcttagctgggatttctggcatgttagcgggcgccttttcgatgggcggcggtgaatacgtctcggtcagcacacaacgtgatacgcaaaaatcaatgatgcgccttcaaaaagaagcgattcaaaacgaatacgatgccgaagtagctagtctacaacgaacctatgaatcaaagggcttaccaacgcccctcgctaaccaagttgcgacagccttcatgcaaaaggatagtcttgatattacgctccgcgaaaaatataacattgaactacaccactattttaatccctggcacgcagccttttcatccttcttctcgttcattttgggttcgctcttaccaatcctcacaattctagcgattccttatccttacaaagtcagtgggaccgtggcatcaattgttgttgccttaatcattaccggctatacaagtgccacgttaggtcatgccaactacttcaaaggcgttttacgcaacgtcttaactggggtcttaacaatggtcgtcacttacttaatcggcggttcgatcggttagatggcatggtttgatttattaatcgcaggattagcagaggtttggtgggcaactactatgaagatgagtagcggttttaccaaactcaactatacgttattaacgattgtcgggatggtggttagctttggctttttaattcgcgcaactaaaggcttaccgctcagtatcgcttacccagtttggactgggattggtgccgttggggcgattttagtcggtgtgattttattcaatgaacatcttagtttgttaacttggttattcgtgattttactcgtgattgggattatcgggattaaagtgacgagcggtcattaattatttttgtgcttgtgctaactgccaacgtgcaatattttggatgagctcaactggaaatgccgcactatcttttttaaattgaagcgtccctttacccgtttgataaggcgcgacttcttttgcaaaatgagctatcggttgattcgttggataaaaaccaacgtggcgcttgttaatgccaaaataacaaagtgccttaggttggtagtagccaactaacccgtaggccaatttaacttcggcatccggcaacgccgtacaaataatcttgtgcattgacagtgcaagctcacgatcacgttcattttctaaaccagccaaatattgtgtcacattatccatttatttaacagctggtgtaccgaaccattcgatacgtgattcaactgtgtctttgattgcttttgtaccaggtgcaagaactttacgaggatcaaagcctttttcagcttcgtctttgtctgcagcgtagtatgctttaacagcttttgaccatgcaatttgttgttctgtattaacgttaaccttagcaatacccatgtcgattgctttaaggatttgttccttaggaatacctgaaccaccgtgtaatacaagaggaatcttgatttcagcagctaattcttctaaacggtcaaagcttaaaccttgccagttttcagggtatacaccgtgaatgttaccaataccaacagctaagtagtcaggaccagcagctgctaattgtttagcttcttcaacatcagctaattcaccagcaccaacgataccgtcttcttcgccaccaattgaaccaacttcggcttcaactgagatacctttagcatgtgctaaagcaacgatttcttttgtctttgctaagttttcttcgaatggtaaatcatgaccatcgaacataactgagttgtaaccaacttcgatacattctttagcagcttcgtagttaccgtgatctaaatgcatgataacaggaacagtgatgttcattgacttgattgtttgttcaaccaagttcttgcataattcgtaaccacccatatatttagcagcacccattgatgtttggatcaagattggtgtgttagtttcttgagcagcgcctaagatagcacgtgtccattcaaggttgtttgtgttgaaagcaccaacagcgtaatgaccttcacgagcagctttaaagatttctgtaccattaactaatgacattcagtcgacatctgtcattttttgatgcatcgtttcaactccgaataagaggacggctccggctgccatcaaaatcgcaaccgtgaagatcgtaaaaatcactgtgattgagactttttgattgatgagatagccgactaaaaacggtccgacaatcccaccaatccgcccaactgctgcggctaatccacttccgctgccacgaataatggctggatattgttctggtgtgtaggcgtacaacgcgccccacgcacccaagttgaaaaaggataacaaggcgccagcactaattaatagaccgactgattgggcggtaccaaagaaataggcactgattgccgttccaattaagaaactaccgaggacccatttacgtccccacttttcaattaaccaagctgcaaaaaagtagccgggtagctgcgccaaggtcatgattaagacgtaaccaaaactgttgaccaaactaaaacctttgagcaccatgacgcttggtaaccagagaaacattccataataagaaaagacgactaagaaccacacaaaccataataaagccgttttttggcggtaagctggttgccacaatttcgtaacgcgctgcataaagggcaatggcttttgaatcgtggctggttcgtggctatccttgacgtgctcccgaaggaccaacgtgtaaacagcggggagtgacgtaatcaataagacaacgcgccaaccccaattaggaatcacaaaatatgccagtaaactagccgctaaccaaccggccgcccagaaactctctagtaagacgactgcccgcccacgtgttgcgtccggtgtattctctgaaattaacgtcgaagcaactggtaactcgccacccaaaccgatacccactaataaccgtaaggccatgaagacgattaatgatgggctaagcgccgataagccgttcccaattgaaaaaagtaatagcgagaatagtaaactattccgccgcccaattttatcagccaaggcgccgaagaagacagcaccaatcgccatcccgattgagccaacactgccaattaaacccatttgaccactgttaaggtgccattctttagcgagggccgcgattacaaacgatagtaagcccacgtccatcgcatcaaacagccaggccccaccagctgcccataatagtttgtgctgttcttttgtcatctaattattaacgtagagaatatcaagtgctgacaaggccgcttttatccgttcaaaatcctgttcagaagcgcattcgatggtgtggaggtgaatcccaccagtgagtgttgagagtagtttttgttcgggatattttttaattttttgcataaatcctttgacatctgtcaagttgttgatgcctaattgccccgttatttcgccgtagacttgatgatcaactgtaacgtcaatcactcgcccgccgttttgaacaatggcggttaattcagcgcgcgtcttggcttgtgtatgctgacacactaattgtgcgcgataaccggtgatttgttgggttgtcgtttgataataatagccgctgaccgtcgcaataatattgacaccctgcgcgcgaatgagcgcaatatcgcccacgattgtctggcgactcacgtgataggtttgggctagttgcttggcactaatcggttggccactgtctttaatcgccgctaaaatggcgtctcttctttgttgagttgtcatttaatttaattgttgtccgttgcttcgaatgacgcgttggtaccagtaaaagctgtccttaggatagcgattaagttccttttcatcagtttcatcccgatcgacatagacgaaaccgtagcgcttctgataaccattcgtccaactcaataaatccgtgaaactccaggttgtgtaaccaatgacggtcacgccatctgtaatggcttcttggattgcttgaatgtgagcctttaaaaaggcaatgcggtaatcatcgtgcacttcaccagcaccatctaggcgatcataagcacccaaaccattttcggtaattaaaaccggtaagctataacgactctcaatgcgccgtaatgccattctaagtccttctgggtcaatattccaatcccagtcggtttgttgcatatacggattgtcagccgtcttgaaaagccctggcacaccgctcgcttgactcgttccttttttaccggaagtattttgtttggttaacccaacgccaccgaccaacggattagccgttacggttgtcgtttggtaatagttgagtcccatgaaatcaggccgggctaatgggtcttgtagtaatgcttgatctgctgccgtgatatctggcagcaacccttcacgcgcccaatagttcagaattaacttcggatagcgaccccaagcataaacatccaaccataaatcggcattcaattgctcagcatcatcagccgcaatctggttcactggatcagcatctagggcataggttggactataggcaaaactaggaccaatcccaccttgataacctttttcgtggaacaacttaatagcactcgcattggctaaattggccatatgattggcttggtaagtccgtttggcatccatcactgctggtggatgttctgcggttaaatagccgtgcgtgatgaagatattttgttcgttcaaggttacccagtgacgcacacgatccccaaaacgttcgaataataaagctgcataagctgtaaaatctggaataatctgccgagattcccatccaccatattcctcttgcaaggcttggggtaagtcccaatgataaattgtaacaatcggttcgatctgattagcaattaattcatcgattaagcgatcataaaaggccaaaccctcttcattcacagtgcctcgcccgtcaggcaatacccgtggccacgaaattgagaagcgataggctttcaagccaactcgggccatcaacgcgacatcttctcgataacgatgatagtgatcaaccgcgacatccccattagtttccttgaaggtcttctcaggaatacggacaaactggtcccagacagactgacccttacccgcttcttgataggccccttcaatctgataggccgccgaagctgaaccccatagaaaatcttgtgggaatggtgctaattgttgatattccatttatcccgctagatatgacttttcaatttgcttcaacatttttttgaagccccgttttctcataaagcctaaaacggcacccatcaataaatcatttgtttgttgtaatttactgtttgccttggcttgttcccggtaaatcacttggattgcttgggggccattggcaaaaatatcataactcgattggtaagtccctcgtgatgaggttgtttcgtagtgatagctctgatccttgatcaattgagtgaccttcagcattgctttaccacgattaccaaacgatttttgatacgaataattagcaagttgcgcttcggtaattttttcgccggtttgttgtttgatatcaaataaaacagacgtcataatcttctgatagaaatcactcgcaggcatactcaaattttgtttaatttccatttagtacgtttcaacaggtaaaccagccatcttacgatagacatcaacaacttcgccggcaaggtctctgaacgtaatagcgttcattaaatgatcttgagaatgaacggttagtaaagtgacatcaatatggtcgccactggcttccttagttaacatccctgtttggacattgtgtgcttctgataatgcagcgtctgattcttgtaatttagcagcagcttggtcaaagtcacccttcttagcggcctgaattgcttccattgcactacttttggcgttcccaccattaataatcaatcccatgattgtttctaagttttgttcatctgccatctagaccgttaaatctttatttttcttgtggtagcccttattcttttgatcgcgtttacgatttttcttacgttttggtttcaaaggttcagccggttggcgtgttggcaatggtttcttagccacttttgccttgcttcgttcacccattggtctgtcatcagcgactggggttttcgttggttgtggcgttggggtggtagcagttttttgaaccggtgcggcttccttcacaactgctggtttggtttcttccaaatgatcgccgaccaaataacgagttactaaatcatattctggtgccaacaatttccgcaagttacggccatcatgttggttccccaacgttaataccgttccttcgcgacccatccgaccagtccgaccagcccgatgaatataggtaattttagcattgggcacgtcaaagttaatcacgtatggtaagtcagtaatatctaagccccgcccagcaacatctgtcgctaaaagcagttgaatcttaccttcacggaagtcttttaacgccttttgccgttctgtttggcgtccttggccggataaagcagcatatgttaccttttggtgtttcaaggtttgagctgcttgtagtaattgggcagattggttgaaaattaccaagcctctaaaattcttttggtgcgctaaatgccgtaagacattcactttttgcgcgttaccagttggaatgaagacgtgtaatacgtccccaccagttttgtcgattgaccgcacatcaattgtttcgattgggaccccaaaccaagtttctaaatcggttaatgtgtccgttgaagttgctgagaagaagcccaattgcacatcagctggtgattcttgcacaatgtggcgggtttctgataagccactgtccgttaataattcatccgcttcatccatgataatggcttgtagcgtatggaattttatcttgcgttgttcgctgagttccaataaacggccagtggttgcaacgataatttctggtttcgtctttaatcgttcaatttggcgcttaacattagctttcccagtaatcgcttggacgttacagtcaatcgccttggcataaggttgaatgacatctcgtgtttgaatgacgagttcttgtgaaggggccaagattaagacttggagaccttcaccgggcataatcttttctaataaggggagcgaaaatgcaagtgtcttccctgaaccggttggggctaagcctaaaattgatttatcctgttttaaaggttggtaaactgcttcttgaattggggaaaggtccttaaacccttgttcatcccatagtgcttgaaataatggtgaaacgctcatttaatgttgatctgcatcaaactggatcccggccgattgtcttaattgatataaaacggcattgaccgattgacttagttgtaataattcatgataccgttttgtgtcgtgattagcaataatggttgcaaaagttgccgcttcagccatcattggattagcaagtgattgttcgccaagggatgttattttttgaccaccctcttcgtataaatcgacttgaccaattgtgcccgcattatctaagacaattgtgctttggccgccataaatttctgatgttaaatatgaatccactgtcttaccaaagattaaagtcacatcgtaatctgggtaatgaagggttgcgacccctttaccatccaccttagttggtagcatttcagcttggtaatcaaccgtaatgggttggccaaaccagctgagtgcatcgtaaacaacataaacgcctaaatcttgtaaggccccacctgaaaaatgaggtgagaaaatattaggttcttcacctgctaaaacggcatcatagcgagatgagtatttcatatacgataaggttgcgccgttgatgcttggtaatttagcaatcgcgtcttgcacaattttgaaattagcttcatgaatttggcgggcggcctcaaataagaactgatcgggatgatccgctaataaggcaatcatatctgccatttcatccggattactgaaagccggcttttcgacaatcacatttttaccggcttcaattgcttgtttggcttgtttaaaatgtaaactgttgggggatgcaatataaacggtttcaaaatcccggcttccaaaaaagccagtgagggttgtatacgtatttgcttcaggggcagtatagtctgttttaaattgctctgccttttcttcagttcttgaataaaccgctgtcaattcgaacgcttctgcctcacgtgcagcattcacaaattgtcctgtaatccagtttgtaccaataatgcctaatttttgcatatgcgaatttttgaatttaaaaaaccaaaagaattatttgatcaaacgattcatcaatatcaacaaaaggcccgggccactcaagccagtaaaacagcaactttttacgcgggtcattggactttcgatgatgaaaaaacgcataaacgacatacgcttgaaatcacgccaaatttacttatccagattgatcacaaaccattaactggtaaggtaattttgttaagtgagaccgagcttatttttctcgaccattttggttaccaactcaaaatcacatgtgaaaaccaccaaccggtttcaatctacgacgaagcagaagacacggaatacccaatcaaataattacctatttaattgtttagccaatgccttttcggctgcttttggtaaatcagctttgtctaccttttgccatgacatcacacctttgcgatcgttaacctttaattcaaggtaggcttgtttttgtaagcgtgaacttttagcactattaaagctcacctttttttgatggccagcctgatcgtatgcgggcaggtcgtattggtaagaaacatatgatttaccttctgtgtccttatcgacctgcttcgtgccgtcagttgtaatttgtgtgtaataggtttcaccaccgtaataatattccttaattccccagctaccgccaataaagaaaatcacgatgatgattaataataaccagcctttgcgtttaaacatctatttaagtttttgccattcttgcggcgtaccggtgaaaaccgccaattgatattctgagtcgtctcggccaccaggtattttgctggcagtggtatactgccaaaaaccgttcttagtgccaactgttggccgttgttgcgttgtttgccacagtggataagtgcccttggttgggacatagcgcttcaataatgccggcgcaccaccgatgatacaatcttggtgataatactgattaacgagcgtcacaaaccgggcaattgcccgttgcgtcttggcttttgccggtggtttttgtgcgtaatcattgtaataggaaagataaaccataattggtagatgtccggtatcttgcccgactgatttgataaattgttgcgcctggtcttcaggtgagctatcaaaactaaaaaagtgataaacccccactgacatacccgagccctctgcccgactgtaattactatcgaaattatcatccttataggaagccccttcggtcgcttttagataaacgaattttaggctttcttttttcaaaatctgataatcttggtagccatcttcttggctaatttgagcccctaagacgggatattgttgctcgttaggccggtcggttcgattctggagccaccaccaaataccggtgatcactgcaatcgctaagaggcttagtaaaactattcggcgccagtagcgcttttgaaaactatcttgaaaaatcggcgtcattcgacgtttcatcgtttcaccccaacttaagcttaatacgcttagtttactattttcattaactgcaaacaaatgctagatgagcgtttactggggttaacattccagctgcccgatgcacaatcggcgggcgtgatttcttttttcggcgtcttatatcattaccgtgttgcgggaccagcggaaactggtctactggttgtcgtcactgatgtatcaccattatacttaacagttacggcccaacacaatgttttagaatactagatgggtatttttctaacgattttattaattgtcattttagttttaattgccatcactttattctcatcttttgccttgatccatactggtgaagtgggcattttagaacgacttggggtttacgtgaagaccttggaacctggtttccaccttgtcttcccatttttataccacatcactgaagtagttaacatgaaacaaattccgttaaaagtagcggaacaagaagttatcactaaggataacgttgtggtcatgatttcagaaacacttaaataccacatcacagacgttaattcatatgtttacaagaataaggattctgttttgagtatggtacaagatactcgggcccaactgcgtgggattatcgggaatatggatttaaacgatgttttaaacgggacagaacaaattaatcacaccctttttgaacaattgagtgctgtgaccgccggctacggtttaaatgttgatcgggtcaatatcgattccattcaagtcgcacatgatattcaagaatcaatgaacaaattactccgtgcttctcgtgaaaaagaagccaatattatggaagctgaagggctcaaagccgctgccatccgtaaggctgaaggggttaaggaagccaatattctagaagccgaagctaacaagcaaacccaaatcttggaagctgaagggaaagcgcaaagtcaaagaaccgtcgctgaagcggttaaggatcaaattaacttaatcaactctagtttggtgaataacggcgaactttacttgcaattcaagaacatcgaagcaatggaacacgttgccgatggccaaaataacaccatcgtgctccctaacaaagcaattgacagcttaggtagcctcccagcagttggcgaattattagcaaataaggacaagcatctataattagtgctcttgctcgtcatccgaattggcccccgcttttggcggttgattcattcgattggtcgtcttgcttaaaatatattgctcgagtagattgataatctgctggttctgcggtaaatcggagtgttgcgcttgatccccggtaaccgtgatttccgtataatgcttgacttgaccctgataaatatacttaccagcctcaacactacgagccgacacaatcccatcattttcgaagttctcagtccccgcgatggaatacatcgacaagttcgagggaatcttcttccgattggcgataaaatccgttaacatttgcgatttatgggccagcgacgtttcttcgaaattatagggtgagccaatcgtcattaattttttaacggtaatgtcatcccgattgaagtaattctctaaaaaggcggtgtagatcaaaccaccgttcgaatgcccgactgctttaaaattattaaactggtatttcttggctaacgccgtaaacgcgattgagaaccatttagcctgtttcttgatattactgtagccatctttgttattttcaaagccaaccacgataaaaggttcgttatcccgcggcttaatttcgccagaataactgatgtgattattggtatccacggttagtttcaataaactatgcttattgccccgctttttattcagtttggtaaccaactcatcaaaacgattctgagtcgcgctactcccaggaatgaagatcaccggagacattttagaatcatggcgtttagttaaagttgcgacgttttggcgcgtccattgtgcagaaggccacatcatcgcgcctaaaaatagaaaactcaagccaaggagaattaaacttttacgttgtaatttagacatttagacatcttggtcaactccttcctgcaaacgatttgcaagttggatgaatggtttataaattaaaacgccgacgaacacgtttagcaaactaatcaccaatgccatccagttaccgttagtcccaataaacgcctgtagcaaccccggcgttcccagtggcacgttataaaccaccgccggcatcaaattgagtgcaatcgccagggccgcaatccccatattaaccagtggcaccagcagaaacgggataatgtataacccatttcctaagactggtagtccggttaaaacggcactgttgaaattaaagaggaccggcatcaacgaccagcggccaatcaaatgctgatcacgctgacgactgaaaagaaaaatagcgattactaaagccaaggtgccaccagtcccaccaatggccccaaatggtccgtaaagtgttcctaacgtgaacggataaggtacgtgccatggtgtatggtgcaagaaggcgtaatttaggttagccgttgcggcaaacccatcacggccaaactgctcaagcgttggcatgctggttaacccaaagaacgtcaagattgtaacgagaactccaattccgagtgaaaaaatcaaactcgtttgattggcttttaaattctgcaattttaagatgacttgatccggtagaattgaaatttccaaccagttgagtaacaaccccactaaaattgcagtgacgaccactaagctaattggcactaacgaatccaatgaacgccccacaattgacccgttattcggattagcaacctgttgcgctttccctagccatctgaaaacaagacctaccagataaccgacgagtaagccgaagaagagcgcacccatccccaacaaattcgcattaaacgtcaattcaccgttgggcgtataccgcaaggctaataaaagataggccactaagcctgtgatgcttgccagttgttcgtcccgaccataatacttggccgtatagcgcgctgttgcaaaagctgcgattgctgccacaatccctaaggttaaactcgttagactattaaacggcacctgcatataattatgcttcgttaaccaagttgaaaagtggaaaatactggcgataaaactatggcgattaaataatgtcagttgaattaattggcttaaactaccgattaacacaaacggaaacaacaacgttaaactcctttgaataatttgatacaatggatgattggtttgaacccgcgtgatccattgcccaaataacagtaatttagattgaacgattactttcatctattttagtactaattttgttactgattctacgtgtaatgtttgtgggaacatgtccactggttgtgtgccttctgcttggtaaccttgtgcggctaacaagtctaagtcacgtgccaatgttgctgggttacagctgacataaaccatcttagcaggtttcaattgaccaacagcttcgataaagcttggttccaagcctttacgtggtggatcaacgattaaagcatcgacttgaaggccgtctgtttgccattgggccatcacatcttcggctttgccgagtgtgaattcaacgttatcaatcgcattgattttagcattatgacgggcatccatgacagctgattcaacgacttcaacgccgtaaacttgcttagcatgtttagccactgctaatgagattgtcccgatacctgaataagcatcgatcactgtttcattgcctgttaattcagctgcttcaattgccttttggtaaaggacttctgtttgcactgggttcacttgatagaatgattgtgctgaaatttcaaatttcaagcccattaattcgtcgcgaataaagtcacggccagcgattaattttgtttgatcaccgaaaatgacgttggtttgggccgcattaacgttttgcatgatgctgaccacttctggaagagccttcttgatttcgatggcaatttcacgggcagcaggtaatttcttactacgtgtgatgaagacaatcatcatttcgtggctgtaataaccgcgacgaaccatgattgttctcaaaacacccttatgcgtatcttcattgtatggatcgatgtagaaacgacgtaagatatcacgaaccactttgattgcttcatcaatcttaggatcttggatgtagaaatcttccattggcatcacttggtgactgtgtttccggtagaaaccggtcattaaggcaccatcgataaaccgaacaggtacttgagccttgttacggtaaccagttggatcagtcatcccaagtgtaggttggactggaatatccaaatgcgctttttggaaaacatttaagatttgattgcgtttaaacgttaattgcgctgggtatgccaagtgttgaagtggtgcgatcccagtttgtgagtagatattagcttttgattcaacacgatctgggcttttctttaataagttaaccaaacgtgcgaaaccgtattgtttgttgacctttgtgacttctacttcggcttgttcatcaggtaaaacaccttcgatgaataatgggtaattgtcaactttggcaacacccatgccttcataggtcaaatccataatatcgaccgttaacttttcattttttcttactggtgcttgaattttcatttaacctattttaccgtcaccgtcgatatcttcttttgatatttcttcgacttctttgacgaattgatcttctgctgcaagctcttctggtgtctccgttgtgattgcgtgatctggaatggcctctttattaacgtacatttcgatgtgttgttgtaagttaataaaagtcattggcgcatcgccaccgtattcaccatctagattaatcatcatcttgtcgttttggtcagctggtcgagccactaacttagacgtcttcgtataaataatccgtggatcatcaacgtgcttgccaccttttaggacaagtgccatcagatgaaccaattcggccatattagccgtcttcacgacgattaatgaaaaattaccgtcatccagttgggcatctggcgccacctgttcgaacccaccgacagaattcgtcaagcctaataagaagagtgatgcttgaccatcataagtcccttcatcgtattcaagatgcatttgaatgggcttaatctgaggcaacatttctgcgcctttgacgatatacgctaaataaccaaagattgatttgaaatcagaaggtacttcatacgtcaactctgtcaacaagccgcccccggcgatgttcataaaataattatcgtttgcttgaccgatatccattttgagcgtttgattttttaaaatcactttcgctgcatcgactggattgtcacgtggaatcttcaaagcgcgcgcgtaatcatttgttgtcccggcaggaataattgccattttagggcgtttagccagtccggcaatcccgttgaccacttcgttgatcgtgccatcaccgccggcggcaaccactaaatcaaaatcatctttagcagcacgtgtcgcttctttttgcgcagatgctggttcaggtgttgtttgataagcgctcgcttcataacccgcttgttctaaaatatccagaatatcagcaacacttcgcttcattacttcatgtcctgaagttggattataaattaaccgtgcacgtttttgcatttatcgtttatttaattcagccatcaataaatcattaacaactttcggattagcttgaccgcgtgtttccttcataatcttaccgactaagaagccaactgcccggtctttaccatttttgaaatcgtcaattgattgttgattatcatcaaggatccctgtgatgattggtgtcaacttagcagggtctgataattgaaccatccctttagcttcaacccacgcttttggatccgtatcattttggataatttcttggaagacctttttagcaatcttcgatgaaataataccgtctttgatcaagttgatcatttgagctaaatgttctggtgttaatgcggtttcttgaaggtcaatttgcttgtcgttcaagtaagcattcacttcgcccatcaaccagttagaaacttgtttaggtgcggcaccgttggcaacagctgcttcaaagaagtcagacatttccttcgtgttcgttaagacacccgcatcatattctggtaagcctaattcatcaacataccgtgtccggcgtttagcaggcatttcaggcatattgtcttgcacttctttcaaccagtcatcgccaatgtgcattggtggtagatctggttctgggaagtaacggtaatcatccgcaccagatttaacccgcattaagtaggtttcgcctgatttttcatcaaaacgacgagtttctggacgaattgtttcaccagcaatcaagagttgtgattgacgcttgatttcataagccaatcctaaacggacatggttaaatgagttcaagtttttcaattctgatttaacaccatatttcttagcgccgattggtcgcacagaaatattggtatccacccgcattgacccttcttccatcttaacatcagatgcgcccgtaaattgaacgatttgacgtaaggtttcaaggtaagcataggcttcttcaggtgttgacatatcaggttctgagacgatttcgatcaaggctgttccttgacggtttaaatcgacgtatgaatagccgtctgaaccatgcgtattcttaccagcatcttcttcgacgtgcaattcagcaatcccgatttgttttttgtgaccatcaatctcgacttcaatataaccgtctttaccaaggggttgttcgtattgtgtgatttgataagcctttggattatctgggtagaaataatttttccggtcaaaatgtgtatcacgggcaatatcagcatgtagtgctgttgcgaccatcatcccaagcgtgtaagcacccttgttcaaagttggcaatgtcccaggataaccccagtcgataacattcgtgttggtattaggttctgcaccataattaacaggagatggactgtacatttttgagttggtttttaattcaatatgcacttcaagtccgattgttgtttcgaaattcatttaggcttgtcctcctttaaagcttggtacgtttttgttaaattctgtggcttgttcaaaggcgtaaccggcacgataaactgattcttcgtcgaaggctttcccgatgatttgtaaaccaactggcatcccatcaacaagaccagcaggtactgacattgctggtaagccagccatgttagcaggaatcgttaagatatcattcatgtacattgtgacaggatccgtgcccttgtcacctaacttgaaggcagttgttggtgttgtaggacccacaactaaatcgtaatcttcgaagaccttttcgaaatcttgaataatcaaggtccgcatttgacccgcttttttgaagtaagcatcatagaaacctgatgataaagcaaatgtgccaagcataatccggcgtttcacttcatcgccaaagccttcagaacgtgatttaacgtaaacatcttcaagcgtcttagcttcaggtgaacggtagccgtaacgaatcccgtcaaaacgtgacaagttagatgaggcttcacttgaagcaatgatgtagtaagtttgaaccgcatattgagaatgtggcaagctaacttcttcaaccgttgcacccaatgacttgaaagtttcgatagctgtttcgatttgggccttaacagttggttcaacaccttctgccatatattctttggcaacggcaatcttcatgcccttgatgtcgccgtttaaagcagcccggaaatcaggtacgtcataatcagcactggtactgtctttttcatcatgaccactgatggcttgtaaaacagttgcgttatcagcaacagttcgactgaagacaccgacttgatcaagacttgaagcaaaagcaatcgcaccccaacgtgacacacggccataagttggtttgataccgacaatcccgttaaaagcagcgggttggcgaattgaaccaccagtatctgtccctaaagcagcgaccacttcacccgcggcaacagctgctgcagaaccacctgaagaaccgccaggcactttatcaaggtcccaagggtttttagtcttcttaaaggcagatgtttctgttgaagaacccatggcaaattcatctaagttggttttaccaatcatgatggcctttttagcctttaatttttcaacaacagtcgcatcaaaaacgggtttgaagttagcaagcatcttgctagcagctgtcgttgtgacaccgtctgtcaataagttatctttaatcccaattggcatccctgctaataagttatcagcatcgattggttgcgcatcgattttggcagctgcttcttgagcgcctttttcatcgatggttaagaaagcatcaacttgttgttctttggttttaatcgtttctaatgtatccgttactaattgactagccgttaagtcaccagcaactagtttgtcatgaacactttgtaaatcttcgtttaaataatccacttaggcttcctccttgtccatgatggcagggactttcaataagccgtctgctgaatctggtgcattcttcattaagatttcacgatctgtccctggttgggcaacatcttcgcgaacaatgttcttgaggccatttacatgagtcgttacgggaacacctgtggtatccacttcgtttaattcatcagtcattttcatgatgtcggcaagttgttcagtgaattgttctaattgttcatcactgaaagctaatttggaaagttctgcgacatgctgaacttgttttttatcaatcatatgaccattacatcatttactcgttttttagccgttgctagccttagcctattcgccggactaacaattcaacatcaatccgtttcagctgctacttctactgtcggtgttactttctcaggcatcaccccagaaatgcaagcaaaagctgcagaagaacgggcggctgaagaagaggtgaatgatgcttggctagatatggacttcaccgacgattctcctgttgaagttgaagaaactgtcaacggtcaaacacagcactattgggaatatgctgatggcacaacaagccaaacagcacctgccgaaacagctgatactgaagacgttgcaacaacaacccaaacagctgctcagcctactgcagaagcagcacctgccgttagcgaacaacaaacaccagaagcagcaactactactactaaacaaacagcaacacctgttaaaaaagcacaacctaaaaaagaaaagttcaaaccaatgccaagtgttgcaacgattaagcaactcacatttgactgggcttctcagcacaagtgattaataactaccgaaaacgtgtgtggtaaagcctttgctgcctgatgcacgcccaacataggcttgcatcccttccgcagatgtaattgagatatcaagcggaatgttacgcggtaaatacttatccgcggccgtcgcaatatactgtgtaaaactcataatttccgtttcactgtagaattgcgtattaaccgtgatattcatgcctgctaagacgccttcttcataatgcgtctgagcggtcacaccacttaagttcgggaagaacgtttcaacttgtgttttaaaactgttaaaagctgtcgcgtcgtcttgattaattgctttttcatcatttacaactggtagcacttgattttcttgattcaattcgtgccatgaatcaatcgttgtgctgccttttttgctgaccccataagcgaagaatgtgccaccaactaaactatccttaggggcttgtttataaagtccaatgacaattgtcgtatcgctgaggcccttcttttgacgcatccggcttaaaactttattagccatttgtttgccttgttgcgtcatcatcgcttttgaaatcttcgtttcaaatgttgcaccgtattgttccttggtatagtaatcaacttgattcatccctaggccaatactcatgcctttcatactgccatcttcacctaaataatcttgttccaatatttgttggagataaattggattccgtttattcggatctttttggccattatcttcggggtttaagccctctgtattcgttttagatttacgtgctaaccatttttgcgcttgggcggtctttaaactttgcccttcttggaaaacatattttgaagtgggaaattgttccttggatagtttaagaagcccactctcaagactcttaacatcaaaagaggtgttactctgttgcgttgttaatccccgagtctggctagttttatactgaccattatcaattacgccttcatacatactatcggtcactttacccgttgtttgtaattttttagtcgctttactacttgaactcgatgaagtgcctggaagacttgtgcaacctgctaacaataaaagagttgctgctgcaacgacccatattttatactttgccacctactgcgccaaataattatctaaatcagcttcgttaataacggggattgccaatgactgtgctttttcaagtttgctaccggcatcttgccccgcaattaacgcatccgtcttcttagaaacagaccctgtgaccttcgcgccgttgtcttcaagcaattgcttcaattcaccacgcgtatactgttctaacttacctgttaaaacaaccgtcttaccgttaaagtagctgtcactagttgccgcttgggctttagtaacacccgtataggttaaattaacaccgactgcttctaattctgccatcaaggtttgcacctgactatccgcaaaataagtcacaaggctgtcagcaataatcgtgccaatcgtatcaaccgtaatgatagtttcttgatcactcgccatcaaggctgctaatgtttggaaatgttcagccaataaacgggcagctttagcgcccacatggcgaatccctaacccaaataataacctttctagcgaattctggcgactagcatcgattgcatttaataaattattaatagatttttctttaaatttatccaattgggctaaatcatccgctgttaaccggtataaatcggccacatcgtggatcaactctttttctaagagttgtgtaatgattcgaggccctaaaccatcgatattcatcgcgttccgggaagcaaaatgggtgagttgttccttcatttgagccggacacattggattaatgcagcgtaatgcgacttcttcatccagatgcactaaatcgtgaccacacgatggacaagttgttggtatgccgtacacttggctatcgctagggcgtttggctaaaacaacttgcgaaatttcagggataatgtcccctgctttatgcagaagtactgtatcaagcaatcgaacatctttatcgcgtaacatatccgcattgtgtaatgatgctcgtgaaacggtcgtcccagctagttgaaccggatccataaccgcggttggtgtcacaaccccagttcggccaacggtccattcgatttcacgaacgacggtctctgcttcttcaggtgggaatttataggcaatttcccagcgtggcactttaaccgtgttgcctaattgacgttggagcgcaagatcatttacttttaaaacaaccccatcaatgccatacgccaaatcgttccgtgtcccttggtattgttcgataaacgcctgtacctcagccatattttggcagacaacagacgttgggttcacgttaaaacctaattcagctaaaacatggagggcctcactttgcgttgtcgcctgcacatcatcaaacgtgacaatcgtatagataaaggcactcaattgacgcgcagctgccaccttagcatccaattggcgtaaactaccagccgccgcgttccgtggattagcaaacggttcttggccttctgcttcccgtttttgattcaaatctgcaaaagccgctttgggcatgtaacattcaccgcggacctcaattgaaacgggacgcgttagtttttgcggaatcgccttgattgtctttaaattctgagtaatatcttcaccaattgtcccgttaccacgcgtggccccccggacaaagcggcctttttcataaattaaatcaatcgctaagccatcgatttttaactcgacattatactcgatttccgttgccgtattttttcgtaaccgttggtcaaacgctgccaactcggcttcagaaaagacatcccccatcgataacatgggaatctcatgcgtgacctttgtaaaacctggtaagacttggccaccgactttttgagttggtgaatcattggtcacaatcaccggaaaagcggcttcgagctgctctaaatcacgatacaactcatcgtacacatgatcttccactaagggcgcatcctgtgtatagtacgcctgactgtagtcggctaattgatcgcgcaattgttgcgcaagtgaagccgcctcactctgggtataatcttcaactggtttggctaatcccatttattctactttttctattggtgcgaagcttgctagtagtctcttgaccccttgttccttgaaggcgatgtctagttcttgatcgccgcctgtgccgttgaccttaacgaccgtaccaatgccccacttcttatgttggactttttggcccgcttgccagctaccgctcttatcaccgccggttgtgtcggcaattttatgactagtcgttgttttaggcccgttatatgtcgtggcggttgctctagcgtagctattcgacttgccaaatggtagtttgcgttctggaatactgccggcattgccgttcgcgtaatccaataatttatcgtcaatttcaccgacaaatcgtgaggcctggttactttgttgacgaccatacaacatccgtgaataagcattcgttaaataaagcttactttcagcacgggtaatcccaacgtatgccaaacgccgttcttcttctaattcgtcttcttccaataatgcccgtgatagtgggaaaataccttcttccatccccattaaaaagactactgggaactcgaggcctttagctgcatgcaaggtcatcatcgtgacttcactggcttcttcttcaacagaatccaaatcagaaaccaatgacaattccgctaagaagtccacaaataaatcactgtcttcttcttcgggttcataatgttcatcaaattgtttcgttacagaaagtaattcttcaatattttctaaacgcgtttgtgattctaatgtattttcaacttcaagtgccttcttgtacccagtcttgtccaataattgttcagtcaagtccgtcacgtttaagaattcacgcatcttcgctaaatcgccaatgacgttcccaaagtcgattaaagtattgcgacttctagcgggaatcgttgataattcagcattttgtgcagcttccaataatgaccattggtgatcatcggcaaactgccctaatttttcgagcgtgccagggccaatcccccgtttagggctattgacgatccgttcaaaactcattgaatcggccgcattaacgactaaacgtaaataagcgaggatatccttaatttctttccggtcgtagaatttgtgtccgccgaccattttataaggcatattagctttaacgaacgcttcttcaatcgtccgtgattgcgcattagtccgataaagcactgcaaagtcgccgtacttacggttattttttttcatttcttcttgaatcttcgtgatgacaaataaagattcgtcacgttcactctggccccgataatacgtaatcggttggccttcttcattttgggtccacaattcctttggtttccggaaagtattgcgattaatgacgccattagcggcttccaaaatggtcttggttgaccggtaattttgttccaacatgactgatttagcgtctgggtaatcatgttcgaagttcatgatattgctgatatcagcaccccgccaaccgtaaatactttgatcggcatccccaacaacacagagattttgatacttctcagctaacatattcaccaatgtgtattgggcttcattggtatcttgatattcatcaacatgaatgtattggaatttttcttgataatgcgccaaagtttccttattttctctaaataagcgaattgtttgcatgattaaatcatcaaaatcaagcgcttggttttgatggagtcgtttttggtattctgtatagcatttggccgccatcttttcaaatggcccattcgctaaaccttgatagtccgctggtgtttgaagcgcatttttcgctttactgattgtccctaaaatcgctttgggttcatattttttagtatcgatatttaaatcccgacaaacatggcgcatcaacgtcaattgttcagaagaatccgcaatcgtgaaagcccggttatagccgatttgttcaatttcacgccgtaaaatccgcacacaaagggcatggaaggttgaaacccaaacatcttgagcgccttcgcctagtaagttacctacccgttcacgcatttcgcgcgctgctttattggtaaaagtgatggctaaaattcgccatggcaatacatgtttttcttcaattaaatacgcaacacggtgcgttaacacccgcgttttaccactgccggcacccgccataattaacagtggcccttcagttgttagaaccgcctcagcttgttcgggattcattccttttaagagctcttgttcagacaaatgattaaatatattttttctgacttagatggcacattgttaaaccaggcgggacaactttccgaaaaagatatcgcaacggtcaaaacaagcccgctaccaatctcattagtttcagcccgttcgccgcaagaaatgcaggcgacggttgagcaactcgcactgacaaccccacaagttgcttttaatggcggcctcatctacaaacctaccgatttattccccatggtcttagccgaatatccactcgtaacaacaactgtcgcacaactagtcgctgcattacaaaccgaatttagcgacattagtttaagtgcttatgatttacagcattggtacacacaaaaaattgatgccggaattgaaactgaggcccaactcaccgggctcttaccaaccatcattaattttgacgaccagttgaaaaatccattcattaaaatttttaaggtgatgctgatggtgccagaagatgaacaacgcacagccgttctacaattcattgaccaacttcacttacctggcctttccgtccaacaatcaggtacaatgtacgtagaaatcaccagtcaacaagccactaaagcacaggccttaatgactattctcaaaaatgccggcttgacgcccgccgactgtgctgcttttggcgaaggtcaaaacgacttatcgatgttaagcatcgtcgggcacccaattgtgatgggcaatgcaagtgatcaaattcaagctgccggtcaatttattactaaaaccaatcatcatagtggctttagctacgggattaaaaaatacattacaaaagttaatcaaaaagtaggttaaatgccaaccattcgtgatattgctagaaaaagcggctattcggtttcgaccgtctcccgcgttttaaatcaacaaaaatacgtgtctgacgctgccaaagaagcgattgaagcggtcatcaagcaactggattacgtccccaatagtttggcgcgtgatttaagctttggccaaaataaaaatattggggtcgtcctaccacacaatgaccatccctatttcaatcaactcttaaatgggatcatggacgccgctttttcgagtggctatcacattgtgttactgccttctgagtacaaccgaaccgttgagctcgattacctcgagcagttgaagcggaagaattttacggcgttgatttttacctcgcacgaactgccgcttgcagttttagaagactatacacgctacggtcagattgtttgctgtgaaaatccggggcagcaccatatttcagcggtgtattccaaccgtgaaccggcctatttagccgcatttaactaccttaaatcgcttgaggttcaacaaatcgggctactcttgagccgcaatttagccaaaagccccacttgggtggctgtcacgggcgcttatcaacagatttttcaccaaaagccggatcagcaattgatgattggtggcatgcgctcttttgaagatggctaccgcgccgccgaacaactgattgcacgccaaccagctcttaattgctattttactaatggtgatgatatcgcggctggcgtgcggcaatatcatttggaccaccaactccccgtccccattttaattgggcaggaaaagcaactctcgagtctcctcctaaaaatgccaacgattgaccatcactttttcactttagggcaaaaagcatttgaactggccctcagcaatcaacaccatgaatgtccatttgaatcggaatttatttggcgctaattatttaaatactctgtcaaagattgtttggacttggctgaggtgccagtggtagtcgaaggcgtcgtccatttctgctggtgttaattgtgccatgacttttggatctgcttctaataattgacggaaatctttttgttcatcccatgcaagggctgttttgggttgtaccaaatcgtaagctgcttctcgacttaacccagaatcaactaacttcaataagactcgttggctgtaaatcaagccgtgcgttaaattcatgtcggctttcattttttctgggaaaacagttaatttttcaataatccgtgtgaaccggtttaagatgtaatctaataaaatcgtcgtatctggcaagataatccgttctgctgaactatgtgaaatatcccgttcatgccataatgaaacatcttccatccccgtgatgacgtgaccacgaatgacacgggctaacccactgacattttcagaactgattggattgcgtttatgtggcattgctgaagagcccttttgacctttagcaaagaattcttccacttcgcgaacttcggtacgttgtaaatgacgaatttcagtagcaaaatgttcgattgatgttgcgacaactgccattgtattaatgtaatcggcatgcaaatcacgtggcaagacttgtgttgaaatatcttgcgcccgaataccaagattttctgtcacgtaagcttcgatttctggtgagatattcgcaaaagtaccgactgccccactgattttaccagcttcaacgcctgctgcagcccgttcaaaacgttcttgattccgtttcatttcagcataccaagtcgccaatttcaaaccgaaagtcgttggttcagcatgcacaccgtgtgtccggccaatcatcaccgtattttgatattcgtaagctttttgtttcaaaacggccataaaccgttcgatatcggcccgaattaagtcgttggcttgttttaaaatatagccttgtgctgtatcaacaacatctgtagacgttaaaccgtagtgcacccatttcttttcggcacccaatgattctgaaactgcacgagtaaaggcgaccacatcatgatgtgtaattgcttctaggcggttaatttcttcaacgtcaaagctcgcattagcgcgcactttagcggcgtcttccgctggaatatcgcctaatttagcccaggcttctacggctaaaatctcaacttctagccaagcttggtagcgattctcagtagtccagatggcacccatttctgggcgtgtataacgttctaacatttaaattaattccgctgcttcaaaattatctaatagtggttgaatattatgccctacagctgtgatataaccactttcttgcgcaccaattgtctggcaacgattgaaataccaatccggcttaatcttcatttgtgtttgaatcagtggccattgttctggcgttgttcttaaacaaacccccgcattatttaagcgtgaagggccaattgctaactggcaaatcgcctttaagtggtattcatattgtgagaagttcaaaatgcggttaagcacatccccagtttcatgtggtgcggtgacaattcgcttaacgtagatgttcatatccgcggtcaagaagaattcaatcccgaagatgcccatataatctaggttttgcccaatcacagtcgctaagcgttcaatttcttctgcgacatcttgatcgatgcgggccggcgtaattgataattgtaaatcttgatcttgcatctgattttcaataatcggtaacgtgacaacttggccttcataatccttggcaaccatcacggccaattcttgttgtttagggacccatgattctaataagtaggcacccaattccaacgtatcatccatcttggccaaatcggctggtgattcaaggtattgatgatattgccgaccgaagccgcgttgaatcggttttaaaatacagggatagccaattgaatcaaccccttgttcaatatccgtcttatcaaccaccgtcacatatggtgagatattgatattgagatcactcaaaaagaccttctcgaggtaacgatcttgcgtcattgagagcgcatcgctaccttgtgggacattgtaatcttgaaccaactgttctagtagtgtttcatcgagcgattcatccgtatacgtgagcacctggcaacaatcgcctaaacgtgcgagtgtttcgtattgctgtggatcgccttcaatctgaatatcaagtactgcggctaatgatgaatcttgtgtctgttcggtgacaattgccgcaacgcggtagcccatttccttagcttttaaagccaacatgtacgcacgttgatcatttccaataattccaatcgtttgacccggataaataactggcatttaattttcgttattttcgtctaagaagaccacttcgccttgttcaaaagcagcaatccgtgctaatgattcaacgtgaatgccgcgttgatctaataattcgcgacctttttggaatgttttttcgatgacaatgccgaccccttcaagttgggcgccagcttggtcgataatttctaataagccttcaaccgcttgaccatttgctaagaaatcatcaatcactaaaacacgatcgttttcgttcaagaatttcttagaaattgaaatatggttgttaaccttcttcgtatatgaataaacagttgcgctatacatattatcttggagtgttaaactcttgtgcttacgtgcaaaaacaacgggaacgtggaaagcaaggccagcaaagactgctggggcaatgcctgatgattcaaccgttaggattttagtaattggggcaccttcaaataatcgtttaaactcttcacccattgctgccatgagttctggatcaacttgatgatttaagaagttgtcaaccttcaatacatcttctcctaaaacctgaccatcttttttaatacgttcctctaataaccgcactcaatcgaattggtccaatcgataggttttgacgagttcaatcaacttctccggataattaggatccgttgcgtaaccatcttgtttgagcgcttgggctgcctgtgtataattggtggctgccacaacgtgttgataatgattatgatcccaagatgtcccgtgcgcaaagagtaagacgtgatctaacatagactcgcgatagtcacggtaaacccgaaagcgcgcggtagtcgtcacccattggccgttcaagtattccttagtggtcatttctttggtattatccgggtcgtcgcctttaatcccaaaatagttatggtaatccgctgcgagcgaactcttgccccaatcactttctaagatggcttgggccaatgtgatgctagagaggacgtggtatttttgttgtaattcttgcgcataaggcgctaattggttaataaattcttttttcttcttcactttagccaactcttcttgtttggcctcattggctaagcgttcctgggtctgtgcgccggtgtattgaatatagagcactaacccaacccccagagcaaataaaacacctaataggacgactagccattctgtcggttgtctcttcttagtgctgtaccattttttagttgtgcgccgttttttcttctttgccacttgacaactcttaactggggcattatgggccttggcaatatcgccggtagttttgcaacttacttcaaccaaccggacggccaaatctatggtgctgcttctcgttcattagaaaaggcaaacgccttcacccaacagtatcatattccccatgcttatggtagctacgctgagatgttggccgaccctgccattgatattatctacgtcgccacacctcacaactatcactttgatgggattatggcgagcttaaacgctggtaaacatgtcttttgcgaaaaagccatcacaatgaaccgtcgcgaattaaatgcggctaaagcactagcggccgaaaaacatttaatcttggctgaagccatgacaatttatcatatgccgctttttgcagaaattgaacgtcaacaagttgcccaagatttaggcgctttaaaatcaattcaagtcactttcgggagcttcaaagaacttgatccaaccaatcgctttttcaatcccgaattagccggtggtgcgatgttagatatcggtgtttacgccctcgcatttgcacggcggatgctgagtgctaaaccagaattgattgccacacagtgggtgccatcagaatctggtgtcgatcaacaatcaacactcctccttaacaatgcccatcaagaaatggtgacggtcacgcttaaccttcacgcgaagatgcctaaacaaggcgtgctcgtttatgaaaaaggctatgtgactgttgatgattatccacgcccagacaaggcccaattgaccttccctgatggcactacccaaactattcaagcgggtgatgctaccaacgccatgaactacgaattacacgacttccaagaagttgttcgtggtcaccaggaaaatgacacactcgccctaacaagcgacgtcatggacattatgaccgacgctcgcgcacaatggggctttgtttacccattcgaacaaccttcagacttagaataattataacggttgactcaacatcaccatatcctgcaatcgaatcccattttcgataattggttgctgatactgttcaaagaagtttttacgaatatgatcgaaacgaaagccctgacgcagataaaaaccgattgctgccaaactgccatccccagtgcctaccagtaatgtccggtacccttgggcaaccatcatctgtttcaaatcgttgagtgcttgttgcccataaccttgattccgataagctggcaataaggcgatatttttcaattcaacttgtgtttggtcaacaaacgtcacatgcataacgccaattacggttgattggccggctaaatgaatactataaagttgaccgtcatttaaataacgacgaatcatcccaacttcttcatccgctaatcgtaaataaggtaagtaatccgcccgcttgtttggtgcaatcatttgataatctaacatttagtttttgtttacgttaacggcttgtggtccacgatcgctttcttcgatatcgaaagaaacgctttgaccttcttcaagagtcttgtagccttcaccttggatagctgagaaatgtacgaatacatcactaccatcttcgcgagttacaaagccataacctttttctgcgttaaaccattttacagttccgttttccatatgctaaaaatactaaaacgattactccccattttgggactactatttctacttgctggttgcgaaaaaccgcttgatacgaaacaacaggtcaaagacgacctcaacaccattttacagatttctaaaacgcaacaaacagcgcttagtaccttagagaatgctggtcaaggggtacctgatagttatcttaagattcaagaaaaataccctgatcaaaatcttttagaggttaagggctctaaaattgcgcaaactgccgcaacacgaaccgcagcttatgacacactcaaggcacaacaagctgaattaaagccagttgttaagcgtttgattaaaattgctaatcaagaaagtgatgaattaccaattgaattcatcaaggatttaaatcagagcttgaagctgtctgcacttgattacacgacactttctaatttctacgacgcggccaccactgctgaaaccgacttttatgccgatcacacatcagctgatgcacacgcagacgatttagcggcacctatcaaccgcttaaatcaatattatagtgccatctaccaacaagcagaaatcgctaaggtcaatatcaatacggtcactgctcaagctaagaaagttcaaaaacaattagactaattattcgcgcttaaaccttaacaatggcttggccacaaacggtgtcacaatcaccgctaaggctatttccatcaaagcattaatcgccacagcactcaacatcacgataattaagtgactgacatccgttttataaataccggctgcttgttggctataaaaggcccacgtcaatagaataactaacgtcgtattaacgatggtcccaaaaaaagcggcgattgccatcgagccccgttgccccgctttagtattgtgtaagtgttgatataataatccggcgactaaccccaccatcaaacgcggtaaaatagcaattaccgggttttggaagatcaataaggttaatgcatcgactggcgctgtataggcgtgaatcagggataatgtcccccagattgcgcctagagttgcgccgccacgagtacctaaaataatcgccccaatgatgacggttaaatgcatcgtggtgacgccgggtaaccctggtagaatataaatataaccaaccatcggcacaaaactttgaatcattaacaatgccgttagaatcgctagaatgctgatcttatacgctgatgaattacgtgtcatatgtttatcgaaaccgctaatttaaccgatatcggtgccttaacgacgctttatcaagctttaacaactgaaatgcacgcattccaaccgactaattatcaagaaaagagcagtcctgatttcttcacctggaaaatgatggttgaagacaaacgccaaactgtctatatcactcgcaatcaggatcagataacgggtttttgtcacgttaccacagcacaaactagtccttccaatctctttatcagccatcaatttgcctacgtcactgcattatacgtccatcctgactatcgtcgccaaggaattgcaacggcgttacttgcaaaagcccgtacttggcaaaaagaaaaacaactcgcttttttggagctaaccgtcttgggcaataaccaatccgccctgcaactctatcaaaaattaggctttgtgacacaaaaccaaacgctccgacaagtttaattaaatttcttttactaattttaaatggccatggcaacgacgacagacataacgcgttgtattgatatgccgttgtcgttgatacaactggccacatttggtgcattgataggcgagtcgtttttgtggtgcctttttaggcgtgaccggtggtgcaaagcgtgccccaccaacctgttgtaaaagccgcttaaagtcttgatcacgatgccgatacccacggtgcaataaatgcaggtggtaatgacacagctcatgtttaataatgccttctaaaacagcctgtccttgggcaaccatcaacgggttaatgtcgatgtggtggtcttgcagatgataacgaccccctgttgtttttaagcgccgattaaaatttgcctggtggctaaacgggcgattaaacgcggttactgaaatgttttgaatgagttgcgttaattcttgatccgtcatcatttaatcagttgctttaggcgccttcatcgtcaattgaacccgttcacgttcttgatcgacgcttaagacccaaacctgaacaacatcaccgactgaaacttcatcagatggatgtttaacaaagtgattggccaattgtgaaatatgaactaagccatcatgtttaacaccgatatccacaaaagcaccgaaatcaatgacattccgcacggttccctctagggccatgttcggtttcaaatcggcgagggttaggacatcatgccgcagcagtggtgctgtcatttgatcccgcaaatcccgacctggtttttgtaaaccgcttaagatatcttcaagcgtttcagagccgaccgctaattcggtcgccaaatcagtcactgttaattgcttaattgctgctgataattctggtgttcctaaagcctccaaagtgacacccaacgattttaaaatcgccttggctactggatagctttcaggatgaatatccgtattgtctaatgggttgtcgccaccgatgattcgcaagaacccaacggcttgttcgaatgccttagggcctaagcgcggcactttcttcaattcactgcgtttttgatataagccgttttcgttacggtattggacaatattttgggcagtcgtcgctgataagccagaaatatgttgcaagagttgtggactagcggtgttcaagttaacccctacgctattgacaacatcttcaatgactacgtctaattgcgtcgtcaattccttttgggcaacatcgtgttggtattgcccgacaccgactgcttgtggatcaatcttaatcaattctgctaagggatcttgtaagcgccgtgcgatactaatcgcactccgctcttcaacgtgtagatctgggaattcagcccgcgctgtatcacttgctgaataaacggaagcccctgcttcgttgacaatcacgtaaaagatttcccgggaaatggtttttaaaactgatgccacaaattcttcagattcacgactagcagtcccattcccgattgcaatcatttcaacattatatttttcaaggaattgcttgaattcatcggcagctgctgctcgtttaggcgctgcagctggtttatgcggatagatcactaatttatctagaaattttccagtcccatcgacaacggctaatttacagcctgttcggtaagcagggtcaaagcctaaaacaactttgcctttcaaaggcggttgtaataaaagatgctttaaattatcgccaaagacggcaattgcttgttgatcagccttttcttttaactgcttccgcaattcacgttcaatggccgggccaatgaaccgtttataggcatcttcaatagctgtcttaataatttgggcggcagctgagtcttgaccatgaataacggcttgagcaatatgaccaacaatcatattttcggcaacttctagcttcaccttcaagataccttcgtgttcaccacgattaatcgctaaatattgatgttccgcaatcttattaatcggtgctgagaaatcataatagatttgataaacttgcttatcatcgctgtcggcatctttcgcctgactcacaatttgcccgttttgacgggtgtattgtcgtgtccaatcccggaaagtcgccgtttcactgatgttttcagcgataatttcgtgcacacccgctaaaacagcatctgtatcggtaatcttttggtctgggttaagataatcggccgctttttccaggaggacttgttctgaaaagttcggtaattgcgcaatcaggttggcaaacggttctaacccagcttctttagcaatcgtcgcctttgtccgccgtttttgcttataaggcaggtataaatcctcaagcacttgtaattggctagcggcttcgatttgcttttgtaaagccggcgttaacttagcttgttcggcaatattcttgataatatcggtcttccgtttttcaagcgttgttaagtattggaaggtgtgttcgatttcgcgaatttgaacttcgtctaaactaccagtccgttcctttcgataccgcgccacaaatggtacggtgttaccttcgtctaataaggttaacacggcattaatttgttgtggtcgatattgcgtcagttgtttggtgacaagttgttgaatatcagtcatgtgcgtccctacctttatcttcaataaaaaaacagcacccgtcttgggaactgtcatctaagcaatttttgagatgttttggatatacttagaaattcgttctgttgctttgtcttggttcatttctgaagcagcaaaagcttgcatatcaactgtttgatcatcatgcatgcttgtaattaaatcttcgcaaccttgaacgaaatcagtataagcaccgattaaacgttggttgttacccattaaacgagctggggcaacggctgtcttaaattgtgctaagaattcgtggtattgatccacaccgtctctgaagatttgggctgtcttttggtaatcttgttcgctcatttcagctaacttaccatcagcaacggccgcttttaaagggacgaaatatttgctcatgccttcttgcactttttcagtgttgtcgattaaatcgttaacagcttggccgtatttagccaacttttgttgtgttttattcatttatttagcagctcttctttggaagaacttcacgatttcaacgatgactactagcataaatgaagctgctagtacaatcccccattgatataaatcaaggtgtgagacatggaataagccattgagccctggaatcatgattgttgcggctaataagataaatgaagctaaaacagcccagttgaaggctttattcttaaagaagccaactgtaaagattgattgatgaactgatttaacgttgaatgcgtggaagagttggatcatccctaacgttgcatacgccattgttaaggcatccgcatgggctaagccacttgcttgatgcactgggaacgtaatcgctaacgcgtaaacggctaaggtaatcccaccttctaataggccttgatagataatcgcttggaacacgccgcctgagaagaagtttgatttacgcccacgtggtttttgattcataatccctggttcagttggttcaacccccaaggcaatcgctgggaaagtatccgttactaaattaatccacaagatatgcactggttgcaggatttgccaacctaaaaccgtcatcatgaatagggttaacacttcacccaagttggctgataaaagatattgaattgatttttggatattagcaaagactttccggccttctttaaccgcaatcacaattgttgagaagttatcatcggctaagaccatatcactggcccctttagaaacttcagtcccggtgatccccatcccaataccgatatcggctgatttgagggctggtgcatcattgacaccatcaccagtcatcgcaacaaccttaccgtgtttttgccaagctttcacaattcgcaccttatgttcaggcgcaacccgcgcataaacggcgtattgagtaacttttttagcgaattcttgatcatccatttggtctaactcagcaccagtaataacggcggcatccgcatcttcttctggggtaataatccctaaacgaagcgcgattgcttcggctgtatcgcggtgatccccagtaatcattagggtccggatgccagctgaatgcgcatctgttacagcttgttttgcttctggtcgttcaggatcaatcatcccaactaagccagcgaaaattaaatcagcttcaatcgttggatcaaccgttgctggcacacttggtaagactttataagccaacgctaagacccgcaaggcttgttttgccaaaccatggttcgtgtctaataataattggcgctctgcatcgtccatcggttgaacaacgccttgtgcgtcgatataatgcgtaacgcgtttgagcaattcatccggtgcgcctttcgtggtcattaagaattgaccatcagcttgttgatgaattgtggtcatcaacttccgctctgaatcaaatggcacttcagcgacccgtggttcggctgctaaggctgcgttaatatcaaaacctttatcgcgcccatacgcgattagcgcggtttcagtcggatcaccaatcatgtcaccatcggccttaattctagtatcattggccaagttcatgattttaagcgtcaaattatccgctggcagtgttgccccagcatcttgtaattgattgttagtgaatattttttcgacggtcatttggttcatcgttaacgtcccagttttatcagacgcaataatatcagtgctccccagtgtttctacagcgggtaacttacgaacgatggcctttcttttaaccatcttttgcgtccctaatgcgaggataatcgtcacaattgcgggtagaccttccggaatcgctgcgaccgctaacgaaatagcagttaataacatgttaattggtgattgtgcatggcgtaagtaacccaccacgaaaacaattgcagcaataattaagatcataatcgtcaaactcttacctaattggctcaagttcatctgtaatggcgtcgttgtttcgtcagcttggttgagcatcccagcaattttaccaacttcggtctgcatcccagtccccgttacaaccccaacgccacgaccgtaagtaacattactattcataaacgccatattggtccgatcaccaattccactttctggatcagttagtgtctcaactgtcttatcaaccggtacggattccccagttaaagcggactcttcgattttcagagcagctgattcaagtaagcgaagatccgcgggcacaatatcaccggcttctagcaatacgatatcgccaaccacgagttcttcactcttaatcgtcacgatttcgccatctcgacgaacgtgtgcatcaggtgtcgccatttcttttaaggcgtcaattgcttgttccgcctttgcttcttggaaaaccccaaaaatcgcatttaagatcacaacggctagaataatgaatgcgtctggccattcatgtgctaaaaagcccgcgatcattgctgcgaccaataacacaataatcataaaatctttgaactgttctaagaaacgaatcgctaaacttttgcgtttcttttcagttaattgattccgaccattttctgccaaacgtttttcaacctgttcttgggttaaaccttgtggcgttgttgcgagcgctttaagtgttgcgtctgttgattgtgtaaaaaatgtggtttgtttatctaccatttattgccagaacgtatcatagattgttattggtaaatgacgcttgtgggccgtttttttgtaccagttttcaatcttcgttgcggcttcttcactgacctgacgaccttctaaatagtcgtcaatttgatcgtatgtgacgcccaatgctaattcatctggtaatgctggacggtcttcttcaagatccgccgttggtaccttttcatagaggtgtttaggcgcaccgagttcggctaacatggccttgccttgacgcttattgagtctgaagattggcactaaatctgcgccgccatcaccaaacttcgtataaaaaccagtaattgattcggctgagtgatctgttcctaaaacagcgccactattttcgccagcgatgccatattgcgcaatcatccgcacgcgggctttaatattgcccttattgaagtcactgacggttacaccggtttccgcaagggattggaccatcgcgtccactgagcccttaatattgacccgtttgacttgatcagctgccataaattcgattgcggccatcgcatccgattcgtcagcttgttcgccgtaaggcaaccgcactgcgataaattggtaactttcatcgccagtttcggcccgcatttcttgcattgctttttcagcaagtgcgcccactaaagttgaatcttggccgcctgaaatgcctaagacatagctttttaaaaatgtatttttctttaggtaagccttcataaaatcaaccgagcggcggatctctttggcggggtcaatcgttggttgtgtttttaaggctgcaataatttctgcttgtaaagcgttcatctagtgcattaaattaacgtcttctctgactttgcggattgaattcatcttattgtcccaagtccgttgtgatagatcgactgggtaatcctgtggattcaagtcacgtttgtattcatcccaaagtgaatcaaggttttcagcacagaacttcttaatggccgctaattcaggcaacgtatagacgcgtttgccgttttcaaaaatagtccgtaagattggtcgggcattgaagtcggtcacggtcttattgatgtatgtgtaattaggatggaacatgtaaatcgtatcttgttcaagtggatcttcatcccataacgtgatgtagtccccttctgatttaccgtcaacttgtttggtaattcgccaaacttgcttgcggcctggtgttgagactttttcagcattacttgatagtttaatggtatcgaccatcttgccatctgaattttcaattgaaaccaacttataaaccgcgcccaaggctggttggtcataagcagtaattaacttcgtcccaacgccccaaacatcgattttagcttcttgcatcttcaagttttggatcgtcttttcatctaaatcgttagaagcgtaaattttagcgtccgtgaagcctgcttcatccaattgttggcgcacacgtttggaaatataggccatatcgccactatcaatccgcacaccttggaaattaatccggctaccgaattcgcgcgcaactcggattgcactcggcacaccactcttcaaagtatcataagtatccacaaggaagacacagtcccgatgcgtttcagcataggcccggaaggcttcgtaatcgttacggtaagcttgaactaaagaatgcgcatgtgttccgcttgctggaatcccgaaaattttagaagctcgtacattactggttgcatcaaagccaccaatataagcagcgcgtgtgccccataaagcagcatccatttcttgggcccggcgtgtcccgaattctaagacgggatccttgccgaccactgatttgatccgtgctgctttggttgcaatcaaggtttggtaattgacaatatttaataacgccgtttcaatcaattggcattgggcgagtggcccttctacttgcatgattggttcattgccaaagaccaattcgccttcaaccgctgaacgaaccgttaaatcaaaatctaattctgctagatacgtcaaaaaatcttcaggataaccgacttcatcccgtaaataagctaaatcgctctcggtaaagcggagattctcaagataattaacgatatgttccaaaccagcaaaaatagcatacccattttcaaaaggtagttttctgaaatagcattcgaaaaccgctgtccgattatggagtccctttttaaaataagttaacatcatattgagctgatacaagtctgtatgtaacaacaaactatcatcaggatataatttttgcatatgcaatttccgacagtctcagttttaaatattccttttatcaatactactaaccaagcatttattgcgcaactttcaaaagacttagccgctaacgaaaaccgttttatcgttactgctaatccagaaattgccctctatgccactaaacataacgattacttccaaacgattagccaagccgattacattacaccagacggtattggtattcttaaaggcgccacaatgttaggcacgccgcttacagaacgaattaccggttttgatacgatgacggccttattcgaaattgccaatcaaaacagctatagcgtttatttgcttggtgctaaggaagaagttttacaagccgcttgccaaaacgttgcaaaacaatatcctaacgtcaccatcgtcggccaacacaacggttattttgacgaccaagaagaacaaaaaattgttgccgatatcgaacgaacacaacccaatattattttggcagcacttggcttccccaaacaagaaacctttatcgaagccaatcgtcacaaagttaacgccatttggatgggtgttggcggtagctttgatgttttatcgggaactgttagccgggctccaaaaatttggcaaaaaatgcacttagaatggttctatcgttttgcatcacatccaagtcgcttgaaccgtttcccagcgcttattgaatacatgcgcttggttaaaaaagaaaagaaaaactaattattttgataatcgttttaatgttcggctgtactgaattttttctaaatagtaccgtctcacattaccgtcactcagcaagatgcccagaaactggagccccttaccaattgatttcgtttttttaacagtgctcaataaattaatattagcgttaaagcggtctttttgatgttgatcgtaaaaccctttttcagttaggtaagcttccagtttcgctttgattgcttcatcactcgctgttaatctaaacacagtcgtctgacgtaaaaagccagaaattagaaaggtttttaacatgtcactttgagtcatactgttttgtctaatccgataacgcatcaacggttcattagtcacacctatttgctgacccgccgcgatcattcgtaaccacaaatcataatcttcacaggcgattagttgttcctgatagccaccaactgtttcaaaagctgcttttttacccagaacactcggatgaacaatgaaattatcatattgtaataactcacgaacggcagctgctgattcaaccatttgtggatgccgaccaatctcggcattagtttcatcaatcagaatcgaagatgatgcaataacatccaattgccgttgttgcaataaatcaaattcagtcattagccgttctggcacagcaatatcatcagcatccattcgcgcaatgtaatcaccccgacttgctttcaatccccgattcaaactaggtgctaaccctagattatgctcgttgctgattaaaacaattcgcggttcttcttttgcatattcatttaaaacagctgccaatgcttgattatcaggattatccaaaacaatgatgaactcaaaattttgataagactgtttcagaattgattcaattgactggcgtaattccgtttctttttcgttataaacggccatcacaatactaattaacggtgtttccatctacaattgtgcatacaaatcatgcatcaaaatcgctaactggcgtgttgaaaatgattgactaacatgcttattaaacgctaagcccatgccaactaattggttattttgataagcagcgtaagcttcatttaacgctttgacatatccttgtaagtctaagctatccacaacccagccatattcagggctatccacaattaccttgctatcaccaacatcggtcgtaatcgcagggacgccataattgccagattctaacaagacggttgggaacccttcgtgaattgacgataaaactgataaatcggtgtgtcgataaaagtgcgccacatctgattgaaagccatcaaaatgaaccttatcagttatttgataatctgttgctaacttcttaaactctgcttctagttcgccatcgccaatcaggtgtagttgatattcaaaatcaacattcgctaacgcttctaacaatagctgttggtgtttttgcgctgttagtctagccacacaaatcatcgtgaattgcggttgcttaactggtgtcggtacttccggactaaattcaatggcattaaaaatagttgtcatcttattcgtatcgatgccttgttgtaccaagctgtttctaaaccgttcggcaatcagatagatatgatccgcttttttaagtacccagagacttaacggcaataaaattttacctttaaaccctttattcagataatcaatcttaggtaacgtgtgcaatgtcaacgtccacttcgccgtaattcgtttccgaattaacgctaagaagagattagaccgtggtccatgcgtatgcacgacatcgatgttttcagaattaatatgcgctgctagttgtttcaagaaatgcggggttaacgtttttggttgttcaaacacttcaaccggtaactgattagcgcgcgctagttctgcaaccgggccatcttcaaaaactaataatgatggctcatctttaccaagtgcgatcattgccttcattaaaccgataatatgtgagcgaccaccgcccgtttcattccctgcgtttacaaaaagaaccttcacttagttttctaaatcttgcttaatttgtgtcgttgaaatacctgttgtccggggaagatagatgacttcacaataatcctttaagaaatcaaactttcctttccaatcatcacccattacgaaaacatcaatatcgtatttttgaacgtctttaattttttgttcccaatctttttcaggaattaccttatcaacatatcgaatggcttcgagaatatatttgcgatgttcatatgaatggtaagcttctttatgcttttcagcattaaattcgtccgttgataagccgacaattaattcatcgcctaattggctggcacgttctaagagatgaacatgaccccagtgtaataaatcaaaggtcccgtaagttaaaacttttgtcattcatcctttcttaaggcgcatcagatcttgccggacacgtgtatttaatccaactaataatatcacgaataaaagaccaacgataatcgtctgaacgatgagatcgaagaataaactgccgaggttaattggtatgtgtaagccaattaatagcgttaagccaaatattagccagtacttccaatgttcatgccacaggaatttaaaatctaagtgccctcgtactaaccaaatccgcatcccacaaaccaataattcggtcaggacaatgatggttgtcccaccattagccccaaagcgaccggcgaatacgaaattcccaattaaggagaagaccgcgccaactaggtatggaatcgcgacaattctgtacatcccttttgatagcgcaaattgattggcataaataccaccataaggaatgatcaccacaagtaaactaacccagaagaagttatccgtcatcgcttgatagcgactaccgaaaaaccaaacgataaatttattagcgttgaccatcagcgcacttgtaaatagcaagccaagtatcaaagtatagtccaacgaaactttcaataaattctgaatttgattttcatccgcttcttcactgtccatcttagccataatcggcattaagacgattgtcaccgaacctaataattgcacaaccgcccgcgccatggtttgcgtctgggcataatacgttaattgaacagaacccgctaataagccaataatggtttgatcaaagctcgtataaaattgtgcagcaactgaaggaatggttaccgtgattgattctttcaaatattgcttagaaaaatgaatccgtccaaacttgaattgaggaatttctgttttaatccctaaccagaagacaaagttagctaggtaagtaatactattgattaatagataaatccaaagatcttgttcactgtgtacgaaaataaaaatcgtagcgactagtgtcaatttaataattgtatttcgcatgaccactgttttaacttggccacggccaatataaaaccaagaaatatctaagacatacccaattaaaaatggaatctcaattagaaaatagaatttataactcatgaataagcagacaaccacgatgtaactaatgatcacgattaaaccactaagaagttgtaaaccccataattttttgaaattttcttcaagattttcttttgtcgattgggcaattactctgacaccaacctggttcattcccatgagaatgataaaactcaagaagactggaatcgagttaacgtaggaattaatccctaacgcttctttgcctaatacccgcgccacgtacggtgtcgtgacaaaaggcagtacaatgatcagcaactgataaacagcattataaatgatatttgttgaggcttttttcatctagactttccaaacttcctgaattattttttgcgtcgccgaaccatcggtattcgcattgtgtaactgattaaacgcttttgtcgtttgcgctgttagcccttgactaagcaatgtatacaacgcttgattgtccgttactaatggccctgggataaaggcttggtagtcaaaataaaagcctcgtagaatatcctggtatttatccaaatcatacgcgtaaaaaacaatcggcttttccaataacgcataatcaaagaaaacagatgaataatcagtcattaaaacatcggcagctagatacaactcttcgatacttgcgtagcgattgacgttatgcacatgtggataagctgcaatgtctggcatttgatctgccacgtttggatgcaagcgaattaacaagtcatattgatcgcctaattgtgcttcaaattgttccaaatctaacgctaatttaaacgtgggttcatcgtctctaaaagttggtgcatataaaattgttttgcgtgttgcatctaattgtagttttgcttttaaactagctaccaattcacgatcatctttatgctttgctaaataatcattccgtggtaacccatagctcataatcttagtttgttttaaattaaatgcccgttcatataaccaattatcttcaggtgcattagacacaaagtagtcccagttaaggggttctcttgcagtcaaacgtttgaagtcattatcatctggtaaatcattaccaatatgtttaagcggcgtaccatgccaagtttgcacaaaaaccccatttttatggggttttagacggaatggaaagttaatatccataatccaatatttagcacgcgcaagtgcctttaaataggccttctcgtgccttgccacgaactgaatgttaatgtccgggtattgggctttaactgtttgtcgcgcttgttcatcgtttaaaacaataatgtagtcactattaggaaacttttcaatcaagccttcaaagagtgctcttggattaccagaaaatgatttcccaaaaaaagaattgataaaaaatgtctcgtctgacatcggagtgactaatttaatcaaaccaaaccaaacgcggtggtataaaactgctttaactgttgcgatagccgtcatttaactgttgcgatagccgtcatgctttttaagtcctctcgttgtgactaatgcatagcctagtgcaaaggccaaaataattgtatctgccaaaaagtccattacattaccactaaatgctgataaggcaataaccaaacctgatccaaataacaaacttacttcaaagaacgttgcttttttgcctagcacacgaattacttcgtataagcaatatagcagtacaaaaacgtaaggcatgattaataataagacgccgatgaagcccattgaataccattgtgaaatgaagtcttgctccaagttggcaatatggttcatccgagtataagaaatcccgaaccaattatttaatgaatcattattaacggatttagcgcggtttaacattgcttcttcaaccttacggtaatttaagcgatcaccaaccggccatttcattacttgataccagaattgtggatcatcacgatatgaatacccgcccatcacaaatctagcatttaatgaataatcacgataatgatttttaatatatctcatcaaaggtgtttctttacgatggtcaatttgatcatccttatgttctttctctttttctttctctttttctttttcagcttctaattcttttttcttttctttttgttctttcttagtaccatcttgtgtcttttgaacagccgtatcggttgttgttcggttaaacattggtgacattggtaaaatagcaccaccaaccaacgttaaaactgcaaatgttgcaaataagctaaatttgaacttaaattctttaaacaacaaactgtaaattaaatataagatgatataaccagctaatacaacgaagaaccctaatgaagcagttttcgtaccaagcatcagcatcgcaaacatttgaacagtcgctagtgcaatactctttaaatctagcttttcaaccaaataataaagaaccatcggtgtcaataatacttcgacagctgaaactgcgttggcataatagaaaaagccttttgatgctaagccatagtatgcccattgctggccgccgccaaaccatgaaaaaatattaccttgaatccagccaccaccatatgatgataagctaattttgaataagttcgtaatcacaatgctaccagaaataatccacgctaaaaatttgatcactttattaaactcagctctagtcaccttaatctgcgttgtgacaaacaagacaaccaacggaattaccattctaatccagtagaagatctcccctactgttgagtaacccaagtcgattgggctagttgatttaaaatgtctcgtaaagatcagatgtagcactagataaataactagaatagccatataaagccaagcaaatcgatttactttattatgacgactactccaaatataaagtcccgcaataatcgctacgagaaaaattctaatcagcgttgctggtgaaaatggcacccaatttgtgactggtggcacatataaaaagtagatatccaaaaacggttgtagcaacactaataaaattagtgatttttttgtatattctttaaagttcacttaatgattcaatatatattgatagaacgtatcggctttttcttgattttcttttgaaaacttgttcgttaatttatgcatacttgataatgctgttatttcttgataacgttgctcgtcaaattgttcgaacaacacttttcccataaggtgcggttcaacgttacccaaccgtggtaactttgcgtattcggcagttaggtgatcacaagcaatcgttaaaaagacatggaacataaaataattatctagcgtatcgtgcgtctgccaataattatataataaatcttgcgttaatactaagatagggtggttagtatcactatgaatgaaccaactcgaagcagcaattgcccgattttgttgttgtgtattgctgtagaaaaagagtggtgcatcaaaaacataacccgggaaattagtccccgtaaaatagactgtactatcaatccaagtgccaccatgttttgttagtagggccacccgtactaaatcggatagatgcgcgtaaggaatcaatcctgcatcaattttatcttgcaggaatgttggaaaagttataaagtcactcaaatttgctaatgttatgatttgcacatgttgtttgggatatagtctcttaatcgtttcgatattgtgtctgactaatggtggtgcatcttcaatcccttggaaccaacaaatccaaatcacgttatttttttcgccgcttgtcgtttgtacttgatattgatcaagaaacgctgtggcttctttttttaacttaacatacgtcaaggcatctgcaaccggcgtttgcttattctttaagtagaaattaataaagcttggagaaagtaatgtcgtcacataattcaatctcttttttagattcatctatttattttgactatcaacttttaaaacttgagaaaacatttctgcgttactattcgtattcttttcaattaaacgccatttagcatatgggaccaacttgccccctatggttttaatcttataataccctctgtaactactatcagtagcctgtggatgaaccgcccaataatattgattatacggtacctctagatataaacgataatctttaggcgtgttatgtttttcctgataggttataaaatcatttttgatacgactcgcatgaccaattcgtgttgctaagcccgcataaaagataacaaccattaccatcattattctgataattggtaagctaaatttaacagcattcaattcgttgcataaggcaactactagcaaacacaaacagaaataacttgcaaacgctcctcgaggaccaaacggtgtaactacaaagaatggcacaattaaaacaatagcagctgcaattaatgcaatatattcgatattgtgggtttccagtgataacttagccatttcaattacaattactaataagaataaaattgataataaacatgatactaaatagcgatggccgaagtcctttaaaaaggtattaaacaaaatataatgatattctatgaaagcaatcaggatactcaattctagataagaaaccacagtccccaacttattacccgaacgcttttggagatttttaataattaagtaacccagaatgacagcaagtaacactgtaataattggattatcaatcaattattgtgaaataatatgataaaccttagtcaatgaaaaacttgtttcccggtaactgtcatgatgtaataatatatttaaataagctttattggaaaacattaaaatgccaccaatatatgtgccaatgaaattagcaattactaagtagtttttctttttttggtatagcatatagcccattaaaattgtggcaactgctaaatttaatagtgtaacgtgttcaacaaaaaagcaactgattattgaaagaaccgctattaaaatactataacgtaaatactttgatgcttgccaatcagaatagtgatacttcactaagttaataataattaagggatataccaatgaagccatatagttaaagaagccggcattccaccctaaaacttgcgcaaacaactctgtactcatcgttaacatcaaaataagaattaataacgtatttctttctaattgcctaacgttgttaatcaaatgggcagccagatagacaactagtgttgtaatacctgcgtaacttaaaaccttaaataccgcactatgactagcaatgataattaaactattaccagcgtaacgtccatcataatttaagaactgacctgatccaaaataattttttaaagtcgttatcccccagtttaaatcatctccagtcaacggaaagttaattgatagataaccaaagaaaataaaaaccagaaaaaagaaaccatatttttttattgcctcattgttacgaactgtcatctaccttattactatatcctcttttaaagtctttttatcatttgcttgccttgagtggatcttttcatagacagtgacccaacctatggcagttaacatgataaatgccgggacaatgaaaaatcgatatctagactgaatctcaattaataaatggaccataaaataaccgatgatcatcaattttaataaataaccgtccgtccatgtttcacgccatttgaatactgctaataaggcatttgctacaataaaaatatagaacaaaaactgaaccgcattcaaccaatttttaatctttaaagataacttaacattatctgccatcccccacattagggcatcatcccgagcagtccacatcttcttacttttattgaacattaaattaacgagcttaggtttatcttggattctttccttaataatctctttgcccagcttatctcgttttgcgccaagtggataccgattcattaagcttaagtccgttgcagagtagctcccaacggtttcatcattcaaccctaatacaaatttccaagttggatttctattttccagcggatattcggataaatgcgttacttgcaaagcgctattcactaagaacaacatgagaaaataggccaaaacactagtggtaactcttccgagtgattttaaaatattttcccgatccggtgccaataaccattttgtaatttcaaaacagacaagtgcaataatcaacaaaatgcccaatggtcgcatcatattcccgagtgctaataaaacaccagcagttgctttaacccataattgatcatgctttaagtatagatagattgctaaataaattaaaaaagttgctagaaattgattcgttaaaacacctgtcatataaatatacgctggataaaatagcaataacgtatacacaatgcgccctgttatttctttaaagtgtagattaataatcttatacccaacaaatgcaattccgcaatttagaaggatgttaattatctgtagaataagcacattttgaccaaatattttgataatcaatgcttgaaaataaacaaagcctaactgataaggccaactttgaaagtaactttcctttagaaatgagaggtcaccttgcgtcgctagtatcgcggcatgatgcatcatttgaaaatcagaactcggtgctgtcgggaccttaatcaaccaaccaattctgactaatatcgccattcccgttacaatcataaagaatatttttttactggttatcttggtcaataaaaccaatgccaagataattaatatgtaaaagacaatagcaacaatcattaatttagaattagataggtaattaccggtgactaaattactgattgagtaatacgtaataaaagcaaaaatgcttaccaaaagtactgtataaacaccctttacaaagccgttcataaattttttcacatgccaactcgttacgacaaagaattcaaacaaaacattatcaacctatataagcaaggcgaatcagctgcccaactggccagagaatatggcattggctattcaacagtccataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatagccactccgttaccgtcaataagtggaaagcggcctcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaaaaagatggctactgatttagtcttaaagacccttgaaagcgcggttaaaaatcgaaccattactggggacctgattatccatacggatttaggatcacagtataccagcgatgattacaatcaacgtttaactgagctacatatccgccactcatacagccgtaagggttgtccgtatgataatgcgccaatggaatcctttcacgcttccctcaaaaaggaatgtgtttatccagtgccggtctttgaagattatgaaactgctgctgccgtcctttttgaatatgtgcatgctttctacaataggaagagaattcatagttcactgggctaccagacccccttacaagttgaaattgcaacacttacgagccaaatggccgcctgattaatgatttatttgagctgtggaaggtaaacgcggttctgaatgtcccttaaaatctgtctcaaatattgacttcaatccattattcatccattttaaaacattcatcttaaatgagccatcaaatgttttttcgggtgataggacatccagtccttttgggccaaaggccttataacgttgaacccacgagacaactagtgagttactcttaataccatattttctcgctattaatttataacctaagggtgacgttagataatcctgaacaacttttatttttaatgttttagaatatttggtcaactattttttccaatcgactagcccgtcattaaaatgatttttatcggtaaacttaaatgtttcttgctgcttgtctttaccagcatttttaaccttaagtatttgttcaataatcaaactatctttcgtttcctttaaaatttgataggtcccccggttagtcataccactcgcatccgatacctgaacaattgtgccatcttcattatatgtaactttagtatcgttactataccaggtaccaagtattgaatattgaaattttccatccgtatttttcccagaagttgtcgattgagcacttgaacttgtcgccgattttttagtactgctcttttcgtttttttgtaccgttacactttttttactagaacttaccttggcctgatcagttttattcccaaaagcaaccaacagtaagctcattaaaataatagtgacccccacgctttttttcttcaattaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaattactcttcgataataaactggtttgaaaataaacaaaatactgtcaaaaaactgattaaaaaactaattttagcgaccactgtatatctataactgacatcaatttgattaaccccttttttcaaattgagacttactgtcccaaattttgttctatcaggtacggtattttgattattaattctagtaataattcctttataataaagaattggtaatttaattttactattctcagttgacttaaccgtcattttaaaatgatccttactaatgattctcattggtttaatctgaccaccattgtattcttttttaactattagatgttctgtatttaaaagagccgctttaggatagtaatctttttgtctaaagcgtttgattttatttaaatcattatttctgattactgataattcagggggaactgatgtctgggcatgccaaagaattctagcacctgaaatcaacgttatcatcaaaatgattatgactaacgacggaactaatctccagaactttcccatatatttagccccaactgaacataaatgcgctaaataaagtgctacaaaaaagcaaaaaatatttaaaaaacgaccaggatattgaataatgctgactggtgtttgctgcaatgcccaccacggtataaccgtcgtagtcattattaaaatcactagtgaaattatccctatcgttcgatataatgttttttctaaccagactgtcataagtattattaccaccgtgctcagaaaaacaatccctatcgtataggttctaaaatctaatgaaaatgaatacctaattaattgttctaagctcttggttacttgcttaaaatcaaacggttgaggcatattaattgtttgaaatcttttttgttccaacattggtccccaataagccattgtcatagtcaaacaaccagctacaaataacaaaaattttttcgttatatagattaagtaagtacgattaaattttttttgaactaaaaagctgaataaaacacagcataaaccaaaactagtcgttacaatagaaagtacatgagaatacaaaataagactaaagaaaataatcacccaacgtaactgttttggctgttgtcgtaataaattataaaagcacaaaaataacggcggtataaatatgtaagcaatgtattcacctaccccccaacggtacattacactagtattacgaatgaaagaaaaagtataaatcaatgcaaataatatgccaaataactgttcccctgagaatttaattgctgatatataactagaaactagtgttaaaaaagttactaaggttagagatagtaaaaatccagataccggtccgaatattactgtcaataaatgcatcgggtaaattgtcaaccatggatagaataatgctgtggcatttccaacaccgccccaatcattaaaattgattggagaataccaaatatgtcttaatgataaagcgcgattcagatgaaaataaccatctaaactatcgcgagcaattaatgtatgctggggtgccatcaaataagtataaaaaatacttagtacaacgaataaaatgataatacctattaatttattatttttcttaacagctttaaccatttatctttccaaataaaattcaaatcgttcgcccacatattgggtgcggacatactcgaaaggttcgccgtttgataagaaggaaacttgtcgtaatttcaagattgggccattacgcttaatgtcgagatattcggcaattcgttctgaggcgagttgggctgagacggtttgttgtgcgccgcccatttcgtagccccctttttcggctaatgctttatagaaggaagacgtgatttcagctttactgaaatctgcaactaagctttgtggcacggttgccacttcaaaacagatgggcacattgtcggcatagcgaatccgttccatgcggagcacctgctcgccatcttttaactggagcttttcagcttcgctaagtgatgggttggcaatgtggaacgaaatggttttactagatggctgcttaccttgggcagtcattagatcggtaaaactagtgacgccggacattttttcttgcaccttttggttagcgacatatgtcccggccccgatgcggcgttccaaaattccttcgtcgactaatgtttgaacggcttgtcgtaacgtcattcgcgacacttcgaaatttaaagcaagctcccgttctgaaggaatgcgatccccaatcgaccacttgccggcttcaatatcttttttaagttgattatgaatttgaatataaacaggtgattccatttaatgttggtaatcttggccgaagctgtaagttgccactaagttttgttgttggtctaagatgtttaaatcagcatcgcgaccaacttctaatttacctttttgtgttaggccgaattcttcagcttggttaacacttgacatcataacggcttcaaatttatcacagcccgtgaaggtttggatattcttgaaggcatcgatgtaagtcaagacagaaccagctaatgtgccgtcttctaaacgtgcttgtttgtctttaacgattactttttgaccgcctaattcactttcgccttcagcaatccctttggcacgcattgagtcggttactaaatcgatacgttctgcacctttttgttcatatgctaatttaatcatatctggcacgatatggaaaccgtctgcgatcaattcagcatacatattgtcttctaacattgcgtgacctgttacaccaggttcgcggtgcttgaattcacgttgggcattgtataaatgtgtgacgtgagttgctttactttcaatcatttgctcccgtgtggcattactatgaccaacagaaggcacgatgttatgtgctaaacaatagtcttcgaaggcttttgaaccaggatcttctggtgcgtaagtaattaaacgaacgcgattgcctgataatttgttccattcgtctaataagtcaacgtctggatctttgataaattgttcaggttgggcacccttaaagattggggtgataaatgggccttctagatggacaccttggattaatgggttcttttcagcagcgtctttaacaccacgcatggcgttggcaatattttcatttgattgcgtcattgttgttgcaaataaagttgtgacaccttcgttttgcatcatcttcgttgccatttcgtcgatttggttagcatcgccatccattgcatcgaaaccgtaaccaccatgacagtgaacgtcgatgaagccaggaatgatagtttgacctttcatatcttggatttcttcgccagcttgtgctttgtagtcaaacattgggccaacagctaaaatctgtttgtcaaaacgaatatagccgtcttcaataacgtcatcaccagtatagattactgcatgttttaaaactttgattgtcatatgctaaatattggggttatcggtttagggaacatcgcgcaaaaagcttatttgccagtgatgacacaattacaagatcaagttaactgggttttatgttctcgtcagcctactaagcttgcacaattacaggcccaatatcactttagcgatggttgcctttcttttgaggccctcttggcaaaatcattggatgccgtttttatccatacacctactaatacccattatacacttgttaagcaagcactctcacatggattacacgtttttgttgataaaccgctcagcgagaacccactggaagtcgctgaactctataaattagccgcacaacaaggcctattattaaccgtgggtttcaaccgtcgttttgtgccgcaattacaaaaattaaaaagcatccctaacaagcaactgattaacgttacgaaaacacgcgttgatacacggcaaccagccgcttttgcgatttacgatttaatgattcatactattaatacagccctttatttagccaatgacgttggtttgagctataacgtgcaaacgtattgtaaacaggatgccaaccaacaattacaagtcgcccaattgaccgttgaaacggccagccaactcatcactgcgacgttaaatatgcaaggcggcactaaccaagaaatcgctagtcttcaaagtccgcacggcttgttcaccgtggataacctgacacaatataccgccaagacggcaaccgataaccggcaacaacaacctgcagactgggaaccaacattagttactcgtggctttgacccaatgatcaaggcctttatcacagccttacaaacaaacggtgaaaatcccgtctcacctgccagcagcttattaacacatcagttgtgccacacgatgtgcagacaagcgcaacgttgttaactatttttggctttccaagtctttttcaattgttgcgtcgatgcctttaaccactgctgacattaaacctgcttcttccattgctaacaagcccgcaacggttgtgccacctggtgatgatactttgtcgattaagtcccatggtgaatcgtcactcatcagaacattttgggcgctccctaaaacagcttgggctgcgatttcagttgcagctttcttggttaaaccgtgtttaacaccagcccgtgccattgaatcgatgaataagtaaacgaaagctggtgaactaccagcaagtgcgctgaaagttgtgaagtctttttcaccaatttcaacaacgccacctaattgtgacaagacgtccttcacgctcttcaattgatcagcactcacttgtgcattaccgacaacggctgtgataccggcgcggttagcaacgttaacgttgggcataatccgcaaaataggtagattatccgcgtccacttgttgacttaatttagccaatgaaagaccggctgccattgagaccattaatggttgtttttctttaaaagcagcgcttgtttcttctagaataagtggcacaatatatggtttaaccgccaagaagacaatatcagcttgtgcgaccaccgcgatgttatctgccactggtgtaatgtgttgttcagccgcaaatgcttcataatttgccggatgagccccgtgaaccaaaatatccgttgttgcgatctgatcagctttcactaagcctttaataattgcttgtgccatattaccgacaccaataaaaccaattttcatttagaagcgtgctaaagttttagctgatgccttcgttgtttgaaccaattcacccacaacgactgttcgctcgtaagtctgaccattgactatctcgccatcaggatcacaggtatacaaagtcactaggcgtttttgccggacatcatccaaaatagctacttggttggccttaaccgttttgcgactgatgacgcgataggtataaacctgcttcgtatcggtcaaataaatcgcggcgcccactttcgtttgaccgagtggtgaaaacaaaatattttcctgggcaatatcgtgactactcaaaacataattccgcttgcccattgtctgtccttgtttattggtaacagccgcctttagcatattatcgtgcccgtttgtttgaccaatacctttgataatcggcaatttaatgccaactgagggaattgccaacttaccaaccgtaatcccccgcgtatcttcatcccaataagttggttgcggtgcattatcgtccgccgtctttttcgtctgaactggtcgcactttgacggttcgtgctcgggcgatattttgcgttaactgatcatgccgatacttttgaacacccatttagtcaacgccttccattaacttgtgaattggtttcacgaagaaaattaagacgatcccgaagatcgcactaacgatcccgatgcctaagaagtatttaatttcagtttgtggtgagtataaacgaactaactgtgcgttgaccgcttgaccagcagcatcagctaagaaccacatactcatcatttgtgatctaaatgcttttggtgctaatttggttgtaatcgaaaggccgattggtgagattaacatttcagcaatttcaacaattaaccatgaaccgattaaccagaatggactaacacgaacagctgtcccgtgtaataatccaggaagtgccataaacatgtatgataatccagcgaagatcaaaccaacggcgaatttaccaggtgctgatggttgtttcttccatgtgctccataaccaaacaaataatggtgttaaaagcatgatgaacaatggatttaatgattggaagttagaagcagcaagcttccagccaccaatatgcaagattgtccgatcttcagcaaacaatgccaagacaactgaacctgattcttcaataccccagaaaacagcggcagcgatgaagagtggaatataagctaaaacgcgtgaacgttcttttttagtaattttcttgcttgaaagcatgttgtagaagtaaataattggtaatgcaattgcgacgattgagatgattaaaacaatattatcaatgtttaaattatttgttaattgtaaaactgtaataccaagtgcaataacgactaagccgataaccactttaatgataatccctcttagttcgtccgctgcgattggatcatttggtttagaattttctttactaaattgtgaacggccacggtagtattgaataaggccgaagaacatcccaactgcggctaatgaaaagcctaaatggaagttaacttgttgtccgattgtaccaacaacccaaggtgccacgaatgaccctaagttaatcccgaagacgaacatactgaaaccagcatctcgacgacgatcatcttcactgtataggccaccgaccatttcagaaacgtttggtttcaataacccagttccggcaacaatcaagccgattgaaataaataaagcagttgcgcccatcggtaccgctagtacaatatgacccaacataatgaagaacccaccgatgaagacggtcttaaagctaccccagattcgatcactcaaccaaccaccaacaacactggctaagtaaaccatagaaccatagatcgccatcactgacattgcggttgccttgtcaaaaccaagaccacccttatctaaagcaaaatacatatagaatagtaaaattgcacgcatcccgtaataactgaatcgttcccacatttctgtgaagaataatgtcgataggccgtgcggttggccaaagaatgtcttttcatgtttctcttccatgtgacacaactcaaattagttgcacttaaaaagttattagcggatcggtggcttaattattacgaagctacctatcaaaatcccaaacaagaggagattaattatcactttgttagtcgtgaggctaatttaacaacagacaaccttaaacatcccgtaacggcctctgctgtcactatgttttgtctcaatcatgatcatagtcaggtcttgttattaagacaatttagactccctctcaacgattatgtctacggtaattcagctggtttaatcgaacctggtgaaacagtcgaacaagccattgagcgcgaactcgtcgaagaaactggctatcaaggtgttcatattgatcaaatctttagtcctagctattctacgccaggtattacagatggtgccatcactttagccatctgtacaatcgatcaacacccctctcaagaaacggctttagaatccgctgaggaattgaccagcatttgggttgataaaaaacgagctgctgagatattagcaaacggtaaaattttaggccgaacacaactactgttatggcagtgggtgaatgatcgtttaaactaattaaatttcttcattttcttgcttatctggacgcattgttgggaataagaggacatcacggatagaagcagcgtcagttaacaacataacaagacgatcaatcccgataccaagtccacctgtaggcggcattccgtattctaatgcttcgacataatcttcgtcgataccttcagcttcatcattaccattttcacgttccttagcttgtgcttcaaaacgttcacgttgatcgattggatcattcaattcagtaaaggcatttgcatattcgttaccatgcatgaagagttcccaacggtctgtaaaacgatcgtcttcggcattcttcttagccaatggtgaaatttccactggatggccgtaaatgaatgttggttgtactaacgtatcttcaacgaattcttcaaagaaggcgttaatgatgtgacccacttgccagtattcttcatacttaacgtggtgttggtctgctaattcacgagcagcttcaactgtcattggttgccagaaatcgacacccgtttcagccttaatagcatctaccatgtgaacacgggcaaaatcaccatctaagtcaattgcttgaccttgatatgaaatttgaccagttcccaagactttgtgagctgcaaaacggatgataccttctgtttcatccatgacatctttgtaatcaaagtatgcagcgtatgtttctaacatcgtgaattcagggttatgtttggtatcaatcccttcattccggaatacacgaccaatttcatagacacgttccatcccaccaacgattagtcgcttcaaatgcaattcaagcgcaatccgtaagtagaggttaatgtctaatgcattgtgatgtgtaataaatggccgtgctgaggccccaccagcttgaccatgcaagacaggtgtttcaacttcagtaaagtcatgtgtatctaaatattcacgaacggcagaaataatcttgctccgttttgtgaaacgatccatactttcaggattagcaatcaaatctaaataacgttgacgataaatttgttcgacattcgttaaaccgtgatacttatcaggtaatgggcgtaatgcctttgacaagaatgttagatgagttgctttaaccgttaactcacccatatcagttttcatgatttgacctgtaatacctaaatgatcccctaaatcggctttcttgaaaattttgtagttatcttcaccgacttcgtctttacgaacataaatttgaatcttacctgaacgatcgcggatatcggcaaaaccaactttacctttaccccgtttagacatcattcgtcctgcaattgttacttcttggtttttaacatccaagtcgtctttttcaattgcttcaaattcttcgtgtagcgctgctgctaaatgcgtccgttcaaaacggctcccaaaaggatcaatgccttcatcctttaaaaattgcattttttcgcgacggaccttaagttggtcattcatttctttttgattatctttttgtgccaattatgccattcttgcttcagtttcttcaacaaaacggtctaaaatgtcgccaaccgcttgttctgtttcaacttcattaactgcagccttcgtcttagcagcgcgaggaatccccttgaggtagtaagcagcttgttgtctaaattcacgacaagcaacgttttcgccctttagttctactaaacgatgcaactggagcttagctgttgcgattttttctcttggtgttggttctgcaatcaattcaccgctgcgcaaataggtttcaacttgacgtaaaatccaagggttccctaaagcagcgcggccaatcatgacggcgtcagcaccaacttcatccaacatgcgtttggcatcttgtggtgtgcggacatccccgttacccataaatggaatcttcaattcagctttgacctgcttcaagatatcccagtctgctttaccggtatacatttgtttacgagtccgaccgtgcatggcaagtgctgatgcaccagcgcgttctgcagcaagggcgttttgaacagcaaggatgtgatcttcatcccaaccagtccgcattttaaccgtgaccggttttttaacagcgtccgtcacatatgaaaccatttcgtaaaccttgtttggatctaataaccaacgcgcaccagcgtctgtttttacgactttattcacgggacagcccatgttgatgtcgatgatgtcagcttgtgtgtgttgatccacaaatttagcggcttccactaatgtatcttttgagccaccaaaaatttggatactcactggatgttcgtttggatcaacaaacatcatgcccattgttttttgattattgtgcataatcccgcggtcactaatcatttcacagacgactaagcctgcgccaaattcctttgcagtcactcgaaatgctgcgtttgtaataccagccattggtgcgacgactacttgatttggaatcgtcacgtctcctatttgccatgtcatctattgttctgctaagatggctttcaaatccgcttcactaaattgatattgtttgccacagaaccgacatgttgcttcggcaccgtgatcttcttcaattaattgttttaaatcttgaggtgcaattgagctgagcgctttagcaaaccgttccttagaacaatcacattcgtatttaacaggtaattcttccaaggtcttcattggtaattcgccaacaatttcggtgatgatttcttctggtgtcatcccctgttgcaatagttctgacacaagtggcatttcttgaagacgcgcttctagaatatcaatcaagcgatcatctgctccgggtaagatttgaatcataaagccaccggcaacgccgattgtgctgtcttcgtttacaaatactgacacaccaactgctgatggtgtttgttctgattttgctaagtagtacgtaaagtcttcacctaattcaccagaaaccaatggtacttgcccagtaaagggttccttaaggccaagatccttagtgacacttaacgtcccagttgtgccgacaccggctttaacatcaatcttatttttctcatttgagggtaagttaacgtgtggattcgtgacgtagcccttaacagtcccttgtgcgttaccgtctactacgatttttccgacaggaccatcaccttcgactttaacagtcatcttagtatcgccttttaaaccagcggcacttaatagtaatgtcccaacaattgtccggccaaaagcggctgatgatgtgggccatgtatcgtgtttttcttgtgcttctgtgacaacttgtgtggcgtttacggcataggcccgtaattgaccatcttctgatacttgtttgactaaataatccttcatttatgcattatcgtttgagtcatcattagttggttttgaatcagcagtatcatccgcaacttctgttgtttctgaatcagcttgttcagcctctaattctgagtcagttttttcagcttctttagcttcaagtgcttttttagcttcttcaaaagtagccgctttttcacttgggaattcttcagcattcttttcaggcatcttaccatcattgaataagcttaagatttctttttcgttcaatgtttcgtacttcaataacatttcagcaatcaacttgtgttgttcacgatgtgcttgaataatttcagttgcttgttgatgtgcttcgtcgattaagcgacgaacttcgctatcaattgcagcagccgttgcttcagaaaaggctgggccttgaccgtaagcagcaccaacgaatggttggccttctttttcaagcgcaaccgttcctagtttttcagtcatcccgtaatgggtaaccatgccacgtgcaatatctgtcgcttgttcgaaatcgtttgaagcaccggttgattgagagttgaagatgatttcttcagctgtccgaccacccattaaaccagtcatttgttccgttaattctttcttactcatcaagaattgatccgtcttaggtaacatgatggcatatccgccagcacgaccacgaggcacaatcgtgaccttccgaacgacacgtgaatcacttaatactaagccgataattgcatgaccagcttcgtgataagccactgtttcacgttctttaggattgatgacccgatcccgtttagcaggaccggcaattacccgatcttcggcttcatcaacatcagaagcatcgatatctttcttactacgacgagctgccacaagggccgcttcgtttaataagttttcaagatcagcaccaacaaaacctggtgtttgttgggcgatttcttttaaatcgacgtcgtctgctaatggtttgttcttcgcatggacttttaagatggcttcacgacccttaacgtctggacgacccacaaggatcttccggtcaaaacgacctggacgtaagagggctggatctaagacatctgaacggttagtagcagcgatgacgatgacgccttcgttacctgagaaaccatccatttcaactaacatttggtttaatgtttgttcacgttcatcatggccgccacccataccggcaccacgttgacgtccaacagcatcaatttcatcaataaagatgattgatggcgctgatttcttagcttgttcgaataaatcacgaacacggctagcaccaacaccgacaaacatttcaacgaaatcagaaccggagattgagaagaacggtacgcccgcttcaccagcaactgctttcgctaataatgttttaccagtacctggaggtccttcgagtaataccccggctggaatccgtgcgcctaatgccgcaaacttacgaggatctttcaagaattcgacaacttcgaccaattcttgtttttcctcttcagcgccagcaacgtcagagaagcgtactttattcgcacccttatccgctttttgcgctttggacttgccaaagttcatcattcggccaccttggccaccgccttgacctgcttgacccatcatcatgtagaataaaccgaacataataattagtggcaagattaggcttaagatgctaacccaccaaccagattgtggttcttgcattgtttcaatctttgttttgttttggttagctaaattcgtaatggcactaacttgtgaatcactttgtaataaagtggttgtaaagtgtgtcactttcttattttttgattgtgaaccaaaaaatgttgacttaggctgttcgtctttttgtgctttacgatattcccctgaaattttataaataccatttgtcggttggattgagaacgacttaactttatccgtcttcaattcacttaaaaaagtacttgattgaacttccttagactctgatccgctattgccattcatgaagaatgaaaatacaccgactaaagccactaggataataatgtaaaacagactattactgaacagtctattcttcttgttgttcatttatttacccgaatatatttccggtttcaaaacgccaattgttcccatattacggtaacgttcggcataatctaaaccgtatccaacaacgaattcatttggcacttccatgccaacataatccgaatgaactgggacaactctacgacttggtttgtccattaaagtgcaaactttaatcgaattagcttggcgcgtcttgaggattgacatcaagtaattcaacgtccgaccagtatcgacaatatcttcaacgataataatatcgcgaccttgtacgctggtatcaagatccttgatgattttcacttcgccagatgaaatcgtaccttcaccgtaacttgaaacgtccataaaatcgatttcgacatgcaaatcaatttcccgaattaaatcagtcatgaaaacaatggcaccttttaaaatcccaatcatcaacggatttttgccttcataatccgccgtaatttgcttgcccaatttttcattgacgcgttgtatgtcttctcttgtgtataaaatacgttcgatatcttgttctaacatttattcacttatataacacagtacgtaccgtattttaccagtttgttcgtgattaaacaatgctgaaattcgaaattctgggtgtccaatcagggtctcttgtgaccagataccccagctattctgccgcttttcatgaggtaccttcaaatcgataaaaagacgtttaagtgttttatggtgggttttatcaatcataattgtatcagttaactggcatggtttggcaacaattggccattgctcatctgctaaccaaattaattgttgacccgatagtttacggggcaaatgattaatctcaaaaataccaatttgttcgttatttggcaagacacaccacttattcagcattagcgttcgacttttttcgtctttcacggctatctcaccaatagtcgtttcaccaatttggaagcgatcatagattttggtaaacaaaagcctctgaccaagggccaactgaccttgtggtttaaccgttgattgaatcaattgcttgagttgttgcagttgggtttcctttagcggactaatttgggggaaatactgtttgatgatgagttgccagatggctgtttgttgcgctgtaggcagtgttttaatcgccttgagctgtccattaataactttgtctgtaaccttcaaatctagtaatggtaataatgtcgtcgtcaattgcgcttgttgccccaataaggctgtcaattgctgactgaagcgattcgcattttgcaagatttggccattttcttgttttaaaaaagggaccaaagtatggcgcacccgattccgcaagacagttgtctcatagtttgtctgatcttcaaaagacgtaatgttattggctaacgcaaagtcgcgtaaatcctgcttagcaaatggcaataagggtctaatcaacgtgccgtcagcaaatggccgttgactttgaatcccacgcatttcgtgcaattcaccactgcgaataaacttcatcatcagtgtttccaactgatcatccccatggtgcgccgtcacgagataatcaaccttttcagcggtcattaagtgttcaaaaaattgatatctaaactctcgagctgccgcctcaatccccgtttgcgggtgttgctgtagcggccaatgcgtcacttgcagtgataaatcattttcaagacagaattgtcgtaggtacgcttcttctgctacactttccgtccgtaactcatggttgacgtgggcgacaatcaattgaggcttaagtgctgtcggtaggcgttgcaaaagcgtcaatagaaccatcgagtcaacacccgttgatgtcgcaacaatcacttttgcgccagttggccaaaactggtggcgccgtatttcgttttgaaaagcttgttcaagcatttaactacgacgaccgccacggcccccacgtttaccttctgtattgcgtttaatagtagacaaacgatcttcactatcttttaagaagcctgatagtaaatcgtcaaagccttccttcttaggcgcacttgtatgttcaggtttacgatacccaccgcgattgttatttggacgactagattgtggccgagtatgctcttgcaccttaggttgatcaaccgcttttcgaattgataatccgatttttccgttttgatctgacatcaccttcacagtcacttcgtccccaactgttaagacatcgtgaatgtccttgatataactatcagaaacttcactgatgtggactaatccggtcttgccttctcctaaatcaacgaaagcgccaaaattcgtaatacctgttaccttaccaggaacttttgaaccaacttcaactgccatttatttttgttgttcgtttaaatttggtgccttatcttgaggcaaactatagattgtttcgcccttctttgaataataatatttgtagcgaatatacttggctaagtagtcatcattatgtaactgagagacctgcacttttaaatccgcttctttggctttggccttttttaaggattgttttttaacaactgtttgcttctcaattaatgccagagaatggtgggtttgcaggatttgaacaccacagacactaaaaagaattaacgcgatgacacccaacgctaataagcgacgcttatgaaccgtccgtgtccgtttcgatttttgttcaaccttttgtttagctgcctgctgtttcgtataggcattttcaatttgcgttatcttacgactcacttattcaaaattttctgcaaccttagtttcaaggatttcatacatttctgccgcatcgctcttcttggttgtttcgataatttgcgtaatcttgacaatcatggttttgttaccaaacccaatttccaatttatcgccaacaacgacgttacttgaagactttgcttgacgatcattaattaaaatccgacctttatctgcaatttcttttgcaactgaacgtcttttaataatccgtgatacttttaaaaacttatctaatctcatctacctttttaatttttgtgctagtttcagcaactgtttaccacccggaatcgttaaccattctcgaattgagaataattgccatgctaaagcaaggctgataaagacgggtaccccgaccgcaatcccaacgccagcacctaaaacggcttggccccttgagaccaaactaggttgaatgacagttaccacaaagcggaccgctacagccatgatgccacagatcaaaaccaatttacctgtaaaatgctggccgtccaaggcatctcgcaccaattctggtgattgccgtaagattaaggctaacacaacccctaaactaatgacagtcccaacactcgcgcccacaatttggaagtgttgtaccaaccattgattaatgaccactttgaccaaaaggccgattaatagcgcaatcgtcgtcttatggaactgatccaaactctgtaaaacactattgcaggcattgattagcgcaataatgacaatacttagcatgtaccacactaaggctttattcccatctgcatccccaaacaacaagtagttcacttgtggcatgagaatcatcaaaccagtcgttgccgccgccgagaggcctaaactgatatgaatcaatgattcagcgacttgttggaattgatgatcttgctgttgttgtcgtgcccgcgaaaggcttggaatcaatgtcgatgaaaaagccattgagataactaagcctaattgcacgagcggttggccccggtcaaatatccctttaaggtttttagcaaaatcctcggttaagccactggccactaagccttttttaaccgtgaatgaatcaaccaactgtaataacactattaatgaagcaaacagacaaattgagcccccttctattaataagcgtttagccaatgaacggtacgcacctaggttaatgcccttcggttttgtccctctgagcacgaaggccttttccgccggtttcaataaggcaactgttgctaccaagcctccgaaaaaggcaccggacatcgcccaggttcccatttcataaacggaccagtgtagcttcagcgacaaccaggccgctaggataatgacaaccacccggacaagttgttcggccacttgcgacgtagccgttggaatcatattgaagatcccttggaaatacccccgcgtaaccgccaaaaacggcatcaataagaacatgtatgacaccattctgattaacggtgctaattcagcatccgccattgccaccgcaattgccggtgcttgatattgcagatagaaaaagatcagtgcgccgaataaccctaatagcgcaaaagatcgccgtaaaatctgtgtttgttcagccggggccgtttcctcagccacaattttagagatataaactgggaaaccacttaacgcaaacgtcatcccaatcccatagatagggtaaacttgctgataaacgtaaaacccggtgttgccaaccatattttgaaatgggatccgatagaccgcactcaatattttggcaacaaaggaggcaattgataagacaactgcgcccttcattaaatgttgcatctgtttattttgcatttattttgccaactgcttcttttcgatttcaacaagtgtttccacaaaaatcgccaactcacgtaaccaatcgccagtcttcatcttaggttggataattaacgtcacacttaatttttcttgttcaaaaccgaccgttgccttcaagcgagttgctgacaaggcttcaaaaatctgttcaccagaaactaagcgactcccttttggtgataagacgacttgaatcttgtctttgacttgtttaatcgtttcgattaacgcatcatcggcattcatttttaattggccaatcgttaagagatgcgcgacttgaacgggataatccccgaagcgatcgattaaatcgctctgaatttccgtaaaggccgcttccgtatccatttggcgaatccgtttgtaaatttcaattttttgccgttgatcattaatataatcatccggcaagtaagcttcgagcttcaaatcaatctcagcgttagtcttagccgccactttcttaccttgtttcttggcgactgcttcgctgagcatttgtgagtataaatcaaaaccgactgaatcgataaagccgtgttgttgtttacctaataagttaccggcgcctcgaatcgatagatcacgcatcgcaattttgaagccggaacctaattcagtaaagtctttaatagcctgcagacgcttctcgctgacctcggtcaacaccttatccggtttatacataaagtacccgtaagcgacccgactactccggccaatccgcccccgtaattgatacagttgggacaagccgtagtgatcagcatcttcgacaatcatcgtattcacattgggcatatcaaccccggtttcaataatcgtggttgtgaccaacacatcatacttaccttgaacaaagtcgtaaatgaccccttctagttgggcctccgtcatttgcccatgtgcatagccgacggttgcctctggcacaagcgcttgaatctcatcgacggtttgttcaatatcactgacccgattgtgcaggtaaaagacttggccattgcgttccaattcccgttcaatcgcttctcgcatcgcaccagcattttgttccatcacataggtttggatggggtaccggttagttggtggggtttcaataacagaaagatcccgcacacccaacatcgacatgtgtaacgtccgtggaattggcgttgccgttaaggttaacacatcgacttgcgcttttaattgtttaagtcgttccttatgtttaacaccaaaccgttgttcttcatcgacaattaataagccaaggtccttgaagacgacatcttttgataatagacgatgcgttccaatgacgatatccacttgccctttttccaagcctttaagcgtagccgtcacttctttacgcgttttaaatcgtgataatagtccgagttcaactggaaaatccgcaaatcgcgctagcatgttttcataatgttgttgcgccaaaatcgtggtgggcaccaagaaagcgacctgcttcccggctgcgactgctttaaacgcagcgcgcaaggcaacttcggttttcccaaaaccaacatccccgaccaacaaacggtccattgggcgtactttttccatatcatgcttaatctcggccgtactccgtaattgatcatccgtttctggatacgcaaactgattttcgaagtcagcttgtagttgatcatcttcaggaaaggcatagcccttttcagcttcccgttgcgcgtacaattcgattaaatcatccgcaatatcttcaatcttagcggaaactttactcttagtcttttgccattccgccccacctagtttattaatcttaggtgttttggattcagccgagacgtatttttgaaccatgtccaactgtgtcactggaataaacagcttcccattatcccggtacaagatggtgatgtaatcctgatggacaccgtcgacttctaaggtctccatcccgacgtattcaccaatcccgtggttgacgtgaacgacgtaatcgcctggctttaattcgctgtaactctttaagcgttccgcattagctaacgtttgccggcgcaccttctttttcggtgcggtattaaataattctttttcagtcagaacgactaattttaaatctggtagttcaaagccattttgcaatgagccttggacaatttgaatctgcccagccaccaacttagttttagtcgtgaccgtcgcttcaatctcaaaatcgtggaaggtttggtcaattttcttcactcgtttggcatctgatactaagacgaccactgtttgttgttgcttttgccaccggctcatttccgtttttaacaatggcatttggctaaagaactgttgtacattgcgggttggcatattgccgagcgtatctagttttagcttacccatccctttttggaataaggataagtataaatgcggatgttggtcttgcttcattaaatgatgaacatcgactaacagtttttgtgccggtagtaagcggcgattgcccaacatatcggtctgccaattagcggcttcttccgctaggacgcgttgtgtttcttgaatgcgaggataatcatcaaaaacaactaacccgctgtttttaaagtaatcaattagactcgtatgatcggggtaaagataatcgacgaagagtgctaagttttccaagcgctcgcctgccaataatcgactaatcggcgtttcgaagttcacggctaacgccttttgatcatcttttgccgttatcttggctgctgtttgttgataatcggcttgcaatgcttctccggccatttcgagttgtgccgcattggctaatagatcagtcgccggcatgatagcgacactctcgaggttttcaatacttcgttgggtatccgcctcaaacgaacgaatcgcatcgacttcggtatcaaacagttcaatccgaactggattttccgtatcaagggggaaaatatcaatgatatcgccccgcattgcaaactcaccaggtttaccgactaatttatcgcgatgatagcccatttcggctaactgtgcgcctaaaattttcggatcgacttcgccgcccatttcaatctgggtctgactatcgcgccattgacgggctgttggcaataaccgtcgcattcctgcaactgacgtcacgacaatcccttttttacccgtcgccaaaaagctcaacgttcgtacacgttcagctcttgattccggtgaactaactgcaatttcggccgccatcacttcttcaacaggaaaggtataaatctggtccccatttaactgattggctaaatcttcagcaacctgattggcttgaaacatattactttcaatgattaataacggctgacgctgttgtttataaatcgttgccaaaaaaagcgtcttggctgagcccgaaaggcccgtaagcagttgtctgacgcctggcttttgattttctaatacggattgcacttgctgggtgttacccaacattgaaattaaatccatctaattaaatttattcattgtcttcataaaatcatcgttttgacaccaatcgtcgattgcttcgcaggcttgatcaatcgcttgattaatcactggtgcgccatctttatcaaatggtgttagaacccaattgaccaccgtacttttttgaggatgttgaatcccaattttaagccgcttgaaggtttggctcttcgtgtgcgcaataatacttttaatcccgttatggccacctgctgaacccttttggcggaggcgtaatttgcccatcgttaaatccatatcatcttggatgactaataattcatcaatcccaacttggtagtaactcatcaatgggccaactgagcgaccagagtcattcatgaatgtcagtggtttaactaataagactgtttcaccttcgtatttgaagctgccatattctgcttcaaaatcatgtttattgagtgttacgttgtatttttcacataattggtcaatcaccataaagccaatattgtgttttgtttttgcatatttactcccaggattccccaaaccaacaatcatcttcatttggcaaacattgaaaaagatcaccaaaaagttatcctcgtcggcgacggcgctgttggttctagctacgcttatgctttaacattacaaggtattgcacaagaagttggtatcgtagatatctttaaagaaaaaacacaaggtgatgcaatcgatttatctgatgcattagctttcacttctcctaagaaaatctatgctgctgaatactcagatgcaaaagatgctgacgttgttgttatcactgctggtgcaccacaaaaaccaggtgaaacacgtttagacttagtaagcaaaaaccttaaaatcttgaagacaatcgttgatcctattgttgaatcaggctttaacggtatcttcttagttgctgctaacccagttgatatcttaacttacgctacatggaaattatcaggtttccctaaggaacgcgttatcggttcaggtacatcacttgactcagctcgtttccgtaaagatatcgctgaaatggttaacgttgacgcacgttcggtccatgcttatatcatgggtgaacatggtgatacagaattccctgtatggtcacatgctaacatcggtggcatcaagatttctgaatgggttaaagctcatccagaagttaaagaagaagaacttgttaagattttcgaaagtgttcgcgacgctgcttacacaatcattaacttaaaaggtgctacattctacggtatcggtactgcattagctcgtattactaaggctatcttagatgacgaaaatgctgtcttaccattatcagtattcatggatggccaatacggcttgaacgatatctttatcggttcacctgctgttatcaaccgttcaggtattactaacatccttgaaattccattgacagaccacgaaatggaaagcatgcacaaatctgcaaaacaattaaaagatatcgttacaaaagcttttgaagaattagatatcgaaactcgccaataattaattagcgtgttccaacgtatgattgaccatcgccatcaaattaatatcatgatccttaagctgtgcgtcccaagtgagtaattccgccttaattgattcataggtttcaatgccctcgggagtcgcattaacgcgcattaatcgttggtcatcttgttcgccacgaatcttataaaccaatcgcttagactgcaagagatttaattttctagaaactgctggtaaggatgttttaaagaaaacagcgagttcacttggtgattttctttcttcttcaataatttgttcaatcaccaaaaattgttcaaaactaacatcatatttgcgactaattgcatttaactttgttgcgatttgttgtagctttgagtaccattctcctaataattgcattcttgtatctgctttaccgaccatgtgaaggtttcaaagaaagcttataccgctttgggcgtcgcagccgttattttaatcggcggttattctgccatgagtctccactacaacaaagtatttttaccgaatacagttgttgccggcactaacattagtggtaaatcgcctgccgaagctaatgaagcattactcaagcaagttaaccaccagaaattcacgttaaaagaagatcaaacgacccgcttatcgtttacagcaaaggatgctggttttagccataatttccaaccgcttttgaagaagattcagtcttctcaaaacggctggtcttggcttggtcatcaattaagcaatcctaaaaaattgcagtctgaaaatgcccttattttaaaccaacaaacttttaaacaattcgcaaatcagacagttactaaattaaatactggtcgaacagcttctaagaatgcaacgattaagttagttaatgaaaactttgaaatcgttaaagaagtcaatggtaatcaaatcgaccaagcacaatttgaaaaaacaattaacaaagcaatcaatcaaggtaaaacctccattgatttaaaacaagactataccgttccaactattaaatcgaccgattcagcgcttcaaaaaacggctaagaaaatgacgaccatcagtgatgaaaaaattcattattccgttaatggtaatgaattcacagtccctaaggccaccattcaaggttggttagttaataacaacggtgcggtgtcacttgataaaactgccgtttctaattacgtttatcaactcaagacaaaatacgatacttatgataaaccattaacctttaaatcaacgaaacaaggaacagttactgtgcctgccggtatttacggttggagcatctcacctgcagatgaaattagcgccctcatgaaagaagtccctgaaggtaaagacttctctagaactgctgttattcgtggttctgggatggcgcaaaaagatcgcagcgttggttcaacttatatcgaaatcgataaaaaggcccaacatatgtggctctaccaaaatggcaaggtaacaatccaaacagacgtcgtcacagcacgaccacctcaaacaaccccgagtggtgtttggagtatttggaagaaagaacgaaacgccacgctcaaaggcactaactttgacggcgtcagtgagtatgcaagtcctgttaattattggatgccaattgatgaaacaggtgtcggtatccatgattcgccatggcaacctaaatatggtggcacttggtataaagaacatggctcacatggctgtatcaataccccaccaacaattatggcccaactttacaataccgttagtgaaggtattccagtggtcgtcatctaaatgttaatcaaatccctagtgttacccaaagaacgtctgaccacgattgaagaatctgtgacacttgaagaagccctaacgattttggaagattccggttaccgttgtgtgcctgttttagatgccagcggtaaaattttccgtggtaatatttataaaatgcacatctaccgacataaatctcaagggggcgacatgcaattgcccgtcacaagcctcttgaagaatatgacgaaatacattccagttgatgcgccatttttcaaggtcttcttcaatatcaaagatttaccttacatcgccgtattagatgaagacagtaacttctttggtattttaacgcatagcactctacttaatatgctttcagaagcttggaacttagaacttagtagttatgtgctcacggtcctttctgccggtgaacaaggggatttagttgccatgtcgaagattatcgccaaatacacgtcgattgccagctgcatgaccttagatgccaaacaagacgaattcgttcgacgcacactcttcacacttcctagtggcttagacatcgaaattctcaagaagatcactaacaaacttgagaaaaaaggctttaaagtgcccgaaattgatgacttacaatctggtaaagttctccgtaatgattctgacgaaattgaaaatgttatttaattaaatttgtcgttcaaaatgtaagacttgatcgaccgcgtacataattggtgcggtaatcgtcatgataacagcttcagaaatcgccaatgtggcatacgttggccagaatgggatttgcgttttagccgttgagccagttaaaacaatcatccaagcaatcatgaacatcgataccgtgaataagatgatattgactagcattttttgccatgttttcttcaaatgaggtatcacaagcgttaaaacaagtaacgctaacagagtttggccgccgccaaataacgtatccaaaatcttattttcagagctaaaaaagaaattgaagacgagcacgccgccaaaaacgccccataaatattttttgttgaagacaaccagatggtttaagccttctgatacccggaactgaatggggctagaagcaaggcccagtacccctggaaatagtgataataccacgtatagcgcagcaactaagccatttaagatcacactacgcaagtgattttgattagtcatttaaggattcaaaacaggttggagcccaacgctaattgttaacgcgcgatcaacttgacgcatcttctcagcaactaaatgcgtgaccttgtctttgagacgttgtttatcaatcgtccggacttgttccaacaagataacagaatcacgctcaacaccattggccttagctgtgataccaacatgtgttggcaacttaggcttttgaatcttcgccgtaatagccgccacgattaccgttggactatgatgattgcccacgtcattttgaataattaacacgggacgcatgccaccctgttctgatcctactactggtgataagtctgcataataaatatcaccgcgttgtatcaattctcccacttaggataaatcaactgtgcgaatgcgggcataagcctcactttcacaagcgttgaattcagcggcgatttgactattaagattggccatttcgacatagccgttaatgacgttatcaaccttcgcttgtcgggttgccataaattcatggatggcatcttgaatcaaatcattctcatcaaggccgtaaacctcgcaataggttttaatctcttgtactaatttaacgtctaagttaacggataatcgttcgtggttagcttccatttagtgttcatttaatccggtatacacacggggaattcgatctgataaatcacagataatttcatagtgaattgtatcagcataatcggccacttcttgtagtgtgatttcatcgtcgccactcttaccaacaaagaccactttcgtccctactggataacgtttgggcaagcgaatcatcatttgatccatacaaatgcggcctacaatttcacaacgttgcccatctaccaagactgttgaaccttgcattcttctcaaccagccatcagcatagcccattggaatcgtaccaatccattcaccttcggatgcttcataagtcgcaccatagccaattttggtgccagctgcaacttgtttgacaaagaccaattctgattcaatcccgagtgctggtttaagcggataaggtaaatcaggaatcgcattaccagaaggattaagaccatataaactaatgcccattcgaataatattaccattacatgccgcatgccataaactcgttgctgagttagaaacatgaacaaatctaggccgttccggtaaagccgtcattagctgattaaaccgtgcgctttgttccttgaaataagtatcatccggatcatcggctgttgcaaaatgcgtgaataccccttcgaaatcgaaataatcagaatgtgctttgataaaggtataagccgctaagagctcagcttcatcgcgcatgccaattcgacccataccactgtctatactcaaatggatgggcactggatggagataaggtacctgttgggcaattgcagccgcttcttgtaaccattcgagtgaaccaactgtcaatgaaatttgattagcagcagctaattcaatttcactaggttgtgtaatcccaagaaccaagattggttctgtgaaattagcccgacgtaacgctaaagcctcgtctaataacgccacacaaaaaccggcggcaccagcggcttgagcggcctccgcgactggtatgaggccatgaccgtaagcattggctttcaataccggaaagatcacggtatctgtaccttcaaggtgttttaattcgttttgaatattctcataaattgcattttgatcaactaaaatgcgtgttggtcgtaagtaaccgactgtcatttaacctctttccaaaataacttctgcgatcacgagtgttgctgtatgtgaaagcgagacgtgaaccacaccatcaaataaatcttgtttgatgtacggtttgccctggggatcattcagcgtttccactgcttgcagttttacctggccaatccctgtcccataagctttactaaaggcttccttaactgcaaaacggccagctaaaaattctagtgcccgacgaccagtataatgactaaaaagttcaaattcagttgccgttaatactttttcagcaaaacgactatttttctcttgtgctttttcaaatcggtcgatttcagccaattatttatcgtttgtccgaattgtgaagttccgttttgaacggccatcagtcttcttacggctgtcgccgcgattgtcgttactacgacgtttgctgctatcaccgttactgctgctacgacggccatctttgctgctgtcgttgccacgacgtttgccatcgccactactacgacggttaccaccacgataaccaccgccgttaccgccacgacgattgccgctattaccaccacgactgccgccgcggtttccgccacgattgccaccctttttacgtgaaggcaatggacgttctggtgtgatcttaactggaacggcttctttactgattgtcttcaaaagaactgaagctaattcaacgtctgagaattgttttaataattcttcagcttcttcgttgtatttagctaattggcctttttcaatcattgagttgatatcagcaacagctgctgctaattgacccttgaaggcttctttttctgaaggtggttgtaaaggtaacatccgtttcttcgttaattcttcaataatccgtaagtattccatttcgtttggtgtcacgaaagtaactgaaacacctgatttaccggcacggccagtacggccaatacgatgaacataactgtctggatcttgaggaatatcgtagttataaacatgcgttacaccagagatatcaagtccacgagcagcaacgtctgttgcaactaagacatccaaacggccagccttaaatgatttcaagacgctcatccgtttttgttgtgataaatcaccatgaataccttcagcattgtagccacgagccttcaaaccacgtgttaattcatcaacacgacgttttgtacggccgaaaatcaatgttaattctggtgattgaacatcgaataaacgggtcataatgtcgaatttttcaaagtctttagcacgaacataatattgatcgattaagtcagcagttaattcttttgacttcactttgatcatttctggatttgtcatgaagctcttaccgattttcatgattggtgcaggtaatgttgctgagaataataatgtttgacgtttttcaggtacttgtttgatgatactttcgatatcatccacaaaacccatgtctaacatttcatcagcttcatctaaaactaatgttttaacgtgatctaatttaacagtccgacgattgatatgatccaatagacgacctggtgtcccaacaagaatttgtgggtgatcttttaatgaacgaatttgacggcgaatatcagcaccaccataaacaacttgaaccttagctttacggtcgcgacctaaacggtaaagttcttcttgtgtttggatggccaattcacgtgttggtgaaatgattaatgcttggatatccgggttatctaaatctaagttttgtaagattggtaaaccgaaagcagctgttttaccagtccctgtttgagcttggccgataacgtccttgccagctaatgccaaaggaattgtttccccttggattggtgttgcttcttcaaagcctgcgcggctaattgctttcatgattggttctgatagacctaattctgagaatttcaactaattgctttcatgattggttctgatagacctaattctgagaatttcaaatagtgttcctccttgttttgtaaaaaacatgccattacaaaacaggtccacttcatcagttacaccattttcaaaaatctgtcttgtaatataattgttttcaagagcctttttcatttaatcgttctcagtcgtcaaagcagccactactttttctaaatgcaagccatgactagcctttaagacgactaaatcggatggttggatggtttctgctaaagcggtaattaattcaggttgctgtgttttttcaaagtagtgtagttgttctgctggataaattgttgcgagcttatcgaatagtggtttaatttccgtcccaaatagataaacttcttggatttgagcaggatctaagaccgttgccaaactctcatgaagtttcttgctagccgttccgagttccaacatgtcccctaagacggcgattcggcgcccatcagtttcaaaatggctaaaattgcgtaacacttcgatagccgctgttggatttgagttatatacatcacttaacattctttgccctgcggtcccgaccaaccattctgttcggttacgcgttacttcaaaattagctaacgccttgctcatcacttctggtttaatgtgataatgttggccaattaaaatagcggctaaggcgttattgacgttgtacgcacccatcattggaatttcaaaagcgacgtctggccaagcattcaacttaaattgcgtcttcgtttcaccagcacggacttgaattggataaagtgtgttggttgtcgcactcccaaaagtttcacgttccaaatcgccaacgcgttcatttaagagtggttcgtcaccgtcatacaccaataagccgtcttcttttaaaaagtcggtgatttccatcttggcatcggcaattttatcccgtgttttgaaaaattcaatgtgtgcttcaccaatcatggtaatggcggccacatctggcattgcgatttcgcttaaagcgtgcaattgtccagggcggtccattcccatttcaatgacgagaatttcagtattggcttccattgacaaaatcgtctgaggaacaccaatttcattattaaagtttgcttgtgttttatgaatattatattgactgcccaatacagcggctgtcatatccttagtggttgttttaccgttacttccagtaatcgccacaactttaggattaatctttagtaagtaccgtttagccaattgttgatacgctgctagcggatctttcacaagtaatactggaaaatcagttggttgatcatcacgtgcactggcccataatgtcgctaccgcaccgttttctcgtgcttgattgataaaatcatgaccatcccgattaccggctagtgggacaaataacgcccctggccgtaattcacgcgcatcaaaagcaacacttgtcacttctactgtcgcccattgttcagtctcatttttcgcaccagtcatccgtgcaatttcgctcaattgcattttcatttaataaggtcgtgaataggcatcacttttttctgctgattgccgatattgttgtttattaggactctgccagccggcaaaagcccggtcgcgtaattgatgatccaattggcgtggcggtcgactatccagttgggcatgttgtaaattattgcggttagcatagttgaaagattcgccatttaataacgcatttttttcggcaatattcaatacatactgtgccggatcactttcaatttgatgaggtgtccgataccgtaacacatcccactgcgtcacaaactgcccagttcgatcaatgataaattcgctatgaaaatcaggcgtcaaccgtttacgattcaagttagtatccgaattaaaagtgacaccgcgcatatatttattatgcaagcgggccggttcccttttcaaccaatacgcccgctgcttcctttgccgttgcgcgacgaatttttggagtgccatttcatcagaatcaccggcagtcttaaaatgggttcgaatatactgaatattttgccgatccagatacattctaaattgatgcagccgctgatccgtcaaatcctggtctttaaaagcaagttgaacactctgcgcaaacgtctttaaaaatggcgcgtccggtggcatttctgaatagatttcaaaatcttctgccgctaattgtaaaaaatggtgcgcatctaattgcgcccccaactgcatcaaaactaaattagctcgctgccaattaatcaaccgattcgttgttcggtccccataagcctgatatagttgctgataaagtggtgaccccacacgatgcagcgcacgattggcagccgttaaattaaacaacggttcttggtttctgataatgctcgcataagcccgcaagctgttatcatcccagttttccaactctaactgggcaaaatgagcgaccagtccgtttttggtgggaagatggtaccgtaattgggttgtctctagccaaagcgcacttaaggccgtaccattacttggctcaatcaaattctgaattaacaactgttccagctttgtttgggttgcagttggcagttgaaataaccgcttgtcctgtaacgccaacagcaattgaccacgtacttgtggcaataattgttgttgtatcatttgccgcatgactgccgttgtttggcgatcttgcaattgcgtgatcagtaccgtctgtaaattcattaatcgtcgtaatttttgattaaccatctacatattacgtaaacgttcgacccgttgttcaattggtgggtgactatcaaataaatgcgcaccaaagctgccgcgacccttaaacggatctgagatatacaacgccgcgctagacggatccgcagcttgcatcggttcactattagaaatcttcaataaggcattgattaacccttctggattccgagtcaactcaacgccggaagcatccgctaagtattcacgattccgcgacaaggccatctgtgcaatgctagccgctaatggccccagaatcattaaaagaattgaaaagactaaggcaatcacattgcctgcgccaccttcacggtcatcatcgcgatcacgaccgccgctccaccacatcatattactaccgatattaacaagtaacgagatgaccgcagctaacgccaaagcaatcgtcgataagcgaatatcgtagttcttgatgtgtgaaacttcgtgggcaatcacgccttctaattcttcacgatttaaccgggccataataccggatgttacagcaaccgcggcatttttaggatcattacccgttgcaaaggcgttgggactatcatcatcgacgataaaaacccgcggcatcggaatctgaccgaccatggccatgtcttcaacaatgtgccacaaatctggatactgactggcatctttaatttcgtgcgcgtgattcatctgcatgaccacattagtggaattactaatcatcattaccatataaacggccgctaagaccgccgcaatgatcacacccgtcaaggtgttttgcatgaagagatagcctaatgccgcaccaattgcgagtacaagcatcaagaaaccaatcatcacatagacggtccgtcgtttattctgtgcaatttgttcatataacatctaatcgaaagaaacttttggcacttctttttcaacttctggcgttgctaagtaagccgtcttttggaagttatgtgccccagcgatgatgttgcctgggaaagtttcaattttattgttaaaacgagttgcacttgaattgaacaattgacgtgcgtaagcaatcttgttttcagtattcgttaattcttccattaatttcatgtattcagcatttgctttcaaatctggataactttctgttaatgacaagatgctcttcaatgattctgataattgattagaaacagccatcgttgcttgacgatcatcacttggcatttctaataattgattacgcatttctacaactttggtaaatgtttcttgttcgtatttagcgtaacctttcaccgttgataataagttgggaattaaatcattccggcgcttgagttgcacatcgatttggctccatgattcatccgcccagttgcggcttttgaccatgccattatacgtgctgatgtaaaacgcaacggtcccaacgattaatactaatataataatcacaactaaccatagcatatgttttctgcacacccaacaattgcggatagcgggctgattgatccgcgatttatcaaacctaacgcggctttaccggcggaatatgtcgcattgtgccaagaaactaacggtggctttttaagccgctttagtctccccactagcgaaccaactagtgatggtttagaccacgttgagtgtcattatctcgctggtattgcaacgggttcacaaacagtcatagaagtggcgcaatggcctgattatttgataccatttagtcaacacggtacgcaatattttgcgttcgattatcaacaatcacctgataaccccagcattcgctacattgataccgaagttgaccagtggttgactgttgcgtcctctttttcccagtttctcgcacaattaggtaccaaaccgattgttgttcctgaaaccgatgacttgacgctgacgccgttgcaacgtaatcactacctattaattgcacctgctgaacaattaatggtgctactagcgctttatgaggctgatagccctaaagactggtatttagactggctgctctttttcgcgcaatctggtaccttagaacagcaaaaatgcgcattagatgcctaccatacacaacgtttatattttaaacgccaattgcctcaagctaagagtcaacagttgacacaaatttttgcacaacaacctgcactactagcgacttaccaagcttatcaaaagcaatggtcgccgctttaaatgttgactcatatccgtcaacgtttattcagacccagagaacaatgggagcaaaaccttgttgttttatggtttgggaatttcatggccggggttgcctttagcctcatcatgccatttatgtcactttatatagatacgttaggcgatttttccgccgcacaactgagtatgtggagtgggttaacctactcgatcaccttcttagtaacggccattatctcgccttggtggggcaaaattgccgatcgccgcggtcgtaaattaatgttactccgtgcttcacttggaatggctattgtcctaggggcaatgggcttagtccaaaacgtctacgagctgattgcacttcgcttgttgcaaggggtattttctggttatatcagtaactcaaacgccctcatcgcaacttccgctcctcaagaaaagagtggtcaagccttaggaaccctgacaactgggaccgtttctggaactctgttaggcccactacttggtggcgttgttgctgaaatgactggttaccgaacgaccttcttcattaccggaaccattttattcgtcgtcttcttactctgtttagctttcgttcatgaaaacttcacaccaatcgaaaaaggtgatcaagttcccggtaaacaactgatccaaaatcttaaatatccccatttaattatcgggatgtttgtcacaacaatgattattcaagcttccaacaactcgattagtccgttgttaagtttatacgttcgccaattaatggaccatggcaaaaatgtcgcgttagtcagcgggattgtcgccgcgattccggggattgcgaccctgattgccgcaccgcgctttggtgccctcggtgatcgaatcgggtccgataaaatcctgattggtggtttgatcttcgcggtcttcgtctacatcccccaagcgttcgttcaaaacgtttggcaattaggcgccttgcgtctgcttgtcgggattgccgatgcagctttattaccacaagttcaaaccattctagccaaatactcgccgcataattccgccggccgtattttcagttataaccaatccttccaagcaatgggcaacgttgccggaccactaattggttcaagcgtttctggctttttcggttatggtggagtcttcatttccaccaccgtcttagtcgtgattaacctcttttgggtcaatcaaaatacccgtgttcttcgtaaaaatcgagcggacgcggctaaaaaaacatcttaattatttcttggtaaacgttaatttatttagccattcccggttgtgtttaatacagaaataaccgatgattgcgattaaaattgagccgaccacatctgctaataaatcgcccatcgtatcaactaatgccgcttgtccacgtagtaagtggccatttgccataaaacgttgcatgtttagacctaataagcgatcacctgtgaactcgtagaattcccagaaaacaccaattgtactgccaaacgttgcagcaaagatactcatcaataatggtgaaatagtttggcgtaaatgactcgaaatcaaggctgaaaaaatcgtataacctaagcctgccaacaagccagcacttaaaatatgcaggaatttatcccaataatagatttgactataaaaatgtaacccggtccctaataaaatcgaacaatagataaaaactaaataaacggcatataatatttctgggaatcgataacgcataaaccgttccaagataattggtaaggtcgcaatgactagccccccaacaacttgaaccatcgtaaaggctaaacccgcattttgatcgggatgatttaacatttcttctaaagcaattccgatatatagcaaatgactcgcaatcgtgaagacgtagacccaatcgacccagcgccaattttgtgttcgttttgccacttattcaattaaatgatgtttttcaatattccgactcaaacgcaaatacgcaataaagtggaagacgtttcccaagaggattaataatgccccgacaacgacattaaactgaatccccaccaatgcaattacgtaaatcagcacactccgtagtggatcattgcgaatggctcggtagaattgttcgtgttgttcttgatggatcatcaaatcttgatgcaccgccatgaaccggtacaatacccaaaatagacccgagatcaccaacgccactagtgcataacttgtgaatgcaaagcgaatatccgctaaatttcgttgcgcaactgcttcggataacagactcgtcgggtaattaatcagcgtgatggcaaacaatagaatcaaatttaagatattgagttgccaattcgtccgtttaattttagcaaaatagtcatgatgaaataaccataacgttcctacataaaaaaatgataacatttaccccaaatgcccaatcttgtagttgggcaacttaaaatctaacactagcagtgtcagcaaaatcgcaaaaaccccgtcactaaatgcttgtagccgatcaattttcatatgccatcatcgaccactaaaaccacgcaatttaaaattatctttgtactatacagcttactgttaggcttattaattggtggcttagccgccgccttcttagcgcttatcaacctcagcacacaccttatttggcaagttggttattcacatttcaaccatcctgcctatcccttagtcatcggattattcggtggcatcctcgttggtttaatgcagcgttcttggggtccttatccgaaaacaatgcacgaaacacttagcgaattcaaacaaaccggcgccgttgcctatcagcatcaagtcggtaaaaatatcattgcggccttagtcgtcctagcttgcggtgccagtttagggcccgaagcagcattatcagctatcgtcggcggcttgatcacttggttgggtgatcgccttaaattaacagcccaccaacaaacactatttttaaatatgggaattggcgcaatgctggctactattttccacgccccattcgctggtgtgggtgaggctattgaaaaaacgccgcttcgcgaacactttaaatcccatttcaaccaaatgctattatatattctaacgacggccacggggttacttggttttactttagtcaatcaattattccccaaagaaagcccgtttgccttacacacgccaaccattcattggacattggcagtctggccattacttattttagcattaattgtcggattcgtttttggcaatctatttttaaaaatcgaacaatggtgtcagtggcttgccgacaccattcaccgaccagttttactcgccgttatcgctggtatttgcctaggcgcttgcggtctattgtccccctatttactgttttccggagaacactatttactaacctttaccaaatccggcttggatcaatcgtttggctacttactcttaatcggacttggcaaaacagttttaaccaacctcatctttgctttcgggtggcgcggtggtaaaatttttccagccatcttcgccagtgcagcaatcggtttaagtttggcagtcctcttcccctacaccccaggactgcttgtcgcaaccgtagtagccgtcagctgtactatcatcgtagcgcaaccgtacgtcacggcgacattattactcttcttattaccgcttcaatttttcccaatcattctaatagcttgtatcggtacgcacaaaattcagcaattatgcattaaataattatttggcagcgttcttgtctgcaaaaccatattttttgttgaaacgatcgacacgaccatctgcttgagtaaatttttgtttaccagtatagaatggatgtgaatctgatgaaatttcaacacgaattaatggatatgtgttaccgtcttcccattcaacagtttcagctgagttagcagttgaacctgagatgaacttgaagccagttgatgaatccataaatacaaccttgtgataatctggatgaataccttgtttcatttattcttcaaccattttaacgacagccccgaggcccgttagtttatcaataacgcgatcatatcctcttaaaatattacttgcgttcgtaatggttgtcacaccgttggccatcaagcccgcgatcatcagacatgcgccaccacgaatttcatcggctgatacttctgcaccttgtaatttatccgcatggtgcaataagataacatcattttcgattgagatatccgcacccatccgaattaattctggaacatgacgcgtccgtttaggataaagcgtatcaacaactaggccttccccttgtgctttcaataaaagtggtgttaagggttgttgtaagtcagtcgcaaaaccaggatatggcattgtcttgacttgtaccatcttcaaatcaggtgatggataaacaaaaatactgtcttctttaacatccatcttaacgcccatttcttctaacttagcaagataagcatccatatgttcgctaatgatatttttaacgttcaccccgtcaccgatggcagctgccatgctgaggtaagtcccggcttcaatccggtcaggaataatcgtatgtgtgttgtggccgtataagtgggccaccccttcaatccgaataatatcagtaccggctccacgaacctttgcacccatattatttaagaaagtcgcgatatcgacaatttcaggttcacgcgcagcattttcaatgactgtttgaccttcagcacgaacagcagccaataataggttaatggttgccccaaccgatgccatgtctagataaattttagcgccgtgtaaaccttctggtgcgttaatttcaatcgccccatgattattggtaaccaccgcaccaagggcttcgaaacctttaatgtgttggtcgattggccgtggtccgatatcatcgccaccaggcaagcccacgattgctttaccgaaacgccctaacaaagcccccatgaaataatatgaagcccgtaaactttgaattttaccacttggtaaaggtgttgatacaatatttgtcggatcaatttcaaccgtatcgcccgtgaaggttgaagtaaccgacatatcttctaaaattgatagtaagctgttgacgtccttgatgtgcggcacactatccagaacaactttggattctgccaaaatcgctgctgggataattgctaccgtactgtttttagcgccgccaattgtcacttcccctgatagaagattaccgccttgaattaacatttttttcatttacattgttgcgccgatgaatgctttgaacaagccttctggtttgtttggacgtgataagaattctgggtgatattgtgcagccacgaagaatttgttttctggaatttcgatgacttcaactaaacggttgtcaggtgaagtaccagcaaatactaagcccttgtctgttaacaagtcacggtattcgttattgaattcataacggtgacggtgacgttgttggataacactttggttatcataagcttcggcagtcttagtacctggttttaacttacatgggtacaaaccaagacgttgtgtcccacccatattttcaagatctttttgatctgacatgatgtcgattaatttgtgttctgcatctgggtgcacttcaccagttgtggcatctgtgataccggcaacgttgcgggcaaattcgatacttgccatttgcatccctaaacagataccaagatatggcacatcattttcacgggcatattggattgaaagaatcatcccttccaaaccacgatcgccgaaaccaccaggcacgatgatgccatcgaaaccagctaatgtttcagcaacattttctttagtgatatcttctgattgaattggtgtcactttaacgtctgtgttataaacataaccagcatgacgtaatgcttcattcactgagatgtaagcatcttgtaattcgatatatttaccaaccaaggcaatcttctttgtaccttcaaggttcttgattgtgtgtaacatgtcgatccattctgtcatgtcagcttctggggctgtcatcttgaagtggttcaagacaaaatcatctaaaccttggttcttcaataacaatggaatatcgtagattgattctgcatcgcgtgattcaacaactgcttcgggttcaacatcacagaattgcgcaattttgttacgcatgtcatctggaattgctttttcagtccgacaaaccaagacatttggttggataccaatgccacgtaattctttaacactgtgttgtgttggtttagtcttcatttcaccagcagcctttaagtaaggcaccaatgttgtgtgaatgtagatacagttttcagcaccgacatccgccttcatttgacgaagtgcttctaagaatggtagtgattcaatatcaccaacagtcccaccgatttcagtaatgacaatatctgaatcagtagttgtcgcagcacgcatgattttttctttaatcatgtttgtgatatgtggaatgacttgaacagttgcgccaaggtattcacctttacgttctttacgtaaaacttctgaataaattttacctgtcgtcacgttagaatatttatttaaattgttgtcgatgaaacgttcgtaatggccaagatctaaatcagtttcagtaccatcatctgttacgaaaacttcaccatgttggtaagggctcattgtaccgggatccacgttgatgtatggatcaaatttttgaatcgttacttttaagccacgattctttaataaacgaccgagtgaagccgcaacgattcctttacctaatgaggaaacaacgccacctgttacaaaaacatatttggtcatatggttcaatccacagaaacaatcttagtattagatatcggtggttcggccgttaaatacggcttttggacggcccaaaaactcgaagatcaagaccagtttccaacacccctcacccggaacaagttctatcaaacagtagctgacatttgtgctgcacacgaaccaattgctgggattgcggtgagctgtcctggtgaaccggacgaagacacagggattgttcacggcatgagctatgtaccctttcttcatctcggtgagttccaacacgattttgcaacccaattaaaccgccccgtctccttacaaaacgatgccgaaagtgccgctttggcggaaatgaccctcggtgtgggccaaaatcatcaaaacgcgttattcacaattatcggttccggtatcggtttggccatcgttcaagacggtctcatcttaaaaaatcttgccgagaagttcgataatcctgaaaagcggttcgctgatacactcaaaacactcaacaattccaaagtctcacccgttcaaattggtaagactgtctcactgaagaatttcaaactgcctaacacgatcgatggcaaaactgtttttgaattggcgaaacaaggcgatcccatcgctagtcaagaagttgatcagatgtatgcgtcactcgctgaaatcctgattttcttaaatgctgcctatcaaccagaaattatcggcattggcggcggcattagcaacagcccggatttgctgccagagctgaagactcatattgaaacgttgctcacggccccagatagccgtatcaatttttataaacgcttctattcaaatcctgaacaggccttcaaacagcccaacctacaaatctgccattttaaaaacgatgccaatctagtgggggccgctctgcattatgaacaacactttgaaacagtcaactaactataaatcgtcatcctcgtcttcttcgtcttcatcatcatcttcgctaaattctgataattgaccttcgataccatcttcaagcgcatcgtcgtcttcatcatcgtcatcgtcgccgatactttgtaagtctgctttatattcagttagatcatcactagaatcatcatctgttactgcaagttctgcctcatcttcaacgtctaaatcttcgtcttcaggatcatcatcactataatcaataacatcgtcgtcatcagccacatcggctaagaaagcattaaccttcttacgacgtttcttcttagttggttggtcttcttcatcttctggatggttaacttcttcatcgacagattcatatgggtaccaagaacgcaagccccaaacgttttcgcctaaagaaataaagctaccatcttcgtttaaatctgtataaaattgtgataagcgtgcacgcacttcttcatcacttttgcctaaataattttggacttcattcgttaagtcagcaaatgcaattgtgtcgcccttgccttctaaaattgcgtgagcgacttctatcattgatagttcttctttattttggcctttaaaaacgtctaatttcaattaagcattaaaaatcaatcgcaatttgtaatcaccaacaacctgttgactgatttctaattgataatgaacaacaacttcaccgctaagtggttcgtctgataatgtcatcaataaatgattagtcgtcgtcaaaactggtaagttgccgtattgtgtttggtaaagtgagccctgtgcatcgtgcattttaaaatagaggcgtaattgtgtcgcatctttttcggtgccacgcgttaattggacttgcccatcttctactaacttaaagcgcacggccgtttcttggccttgtgcgtgttctaagtaacgaagataagtcgtcgtgcccatttggatcaattcgccttcttcatcgaaaacgtggctttcggtttgaccatcttgtgtaatttctgtttcaagatgaattttaatcggcgtactctttttgctagccatttgcaagatttagcgaccctttatccccagaaaacttggtccgttgttaatcaacaattttcggccgaccaaggtcaactcgcttttgcccacgcgaatacactgttggccctcaccaaagaatgccaacaaccaattattcatttttggacactcgaaaaaacagtcatcttaggcatgatggataccaaattgcctgacctgaccgctgctactgatcaattgaccgccgcgggctatcactattttgtccggaacgctggtggtcttggcattgttgccgataccggtattctcaatctgggcttttacctgccagaagtcgctgatcacctctctattaatgcggcttatgaattaatgaagaccctttttagcgaaaccttcaacacgagtaatatcaccatcgcgcattttgaagtgcagcattcttactgccccggcgaatacgaccttagtatcaacgggcaaaagttcgctggcattgcgcaacgacgctccaaaaacgggattgcgattttactatacgctagcattgaaggcgaccaacaagcacgtggcactttaatgcagcatttctatcaagctggcaaagcccaacaacaaacgcgttggaccttcccagatgtacatcccgaaacaatggctaacctcgctgatttactgcaccaaccactcacggtggctagtgtcagccaacaattaagcgctagcttgcaatcaaatgccgggttaaccttgcaatcagatttacaaacactgatgcaagaagccgactaccaaacacaactgaccaagaacacacaattattgcgccggtatcaaccaggataccagccttaggtgacctatgcccctcaaaaactaacccgcgaaaaagtatttcgcgatcctgttcataactatattcgtgtcgactatcaagtgattctcgatttaatcgatacgccagaattccaacgacttcgccgaatcaaacagttgggtacgacttcgtctgtcttccaaggggcagaacattcgcggtttacccattcattaggcgtttatgaaattacgcgtcaaatctgtgatcaattccaaatcaattaccccaccaagcaacctgacgatggcctttggaatgacagcgaacggctcgtcgcactctgcgcggccttattacacgatatcggtcatggtgcttattcacatacttttgaacacatctttaatacagatcacgaatcaattacccgccaaattattatgacacctgaaaccagagttaatcagattctgagccaagtcgcacctgattttcccgcaaaagtggccagtgtcattgatcacacttatcctaatccacaggttgtccagatgatttctagtcagatcgatgctgatcgtatggattacctattgcgggatgcttataataccggcaccaaatatggtgaattcgatttaacccgtgttttgcgggtcatgcggccctacgctaatgggattgcctttttagccaacggcatgcacgcggttgaagattatatcgtcagccgttttcaaatgtaccaacaagtttattttcacccagtctcacgtggtatggaagtcgtcttacaaaagttgctccaacgcgctaaatttctctacgaacaacctgatcatcaccaaagcttggcccctcaattattaattcctttcttcgaacaggatttcaccttgcgggactatctcaaactcgatgatggcgtcttaaatacctattttatttactggttggattatcctgataccgttttaaacgatttagcggaccgctttctcagccgccgtcctttaaaatcagtgaaatttaatccatcaacagaagattgcttaccggaaatgcgggccctcacggaacaagccggctataacgcaacctactataccgccgttaacaacagctttgatctcccgtatgacgcttacgacccgtcagctaagtcgcccaaaacacagattgaaattattcagtctgacggccaattaaacgagctttcttcaatcagtaatttggttgctgccatttcaggtaagttctctggggatgaacgtttctattttcctaaagaaatgagcgataccgccaatctcgaagtttttgcaccaatttatcaacaatttaacagttacatcaataatggtgcgattcaagcgcacccccacaaccaataaatgtcaattaaactcgtcgcagtcgatatggatggtactttattaaacgaaaataacgtcctcagccccaaaaccattgaagtggtcaaggccgctaaagcccaaggcatcaaagtcgtgctttgtaccggtcgcccacttactggtgtcacacccttcttacacgaattagggctcacagatagttctgattatgtaatcacctttaatggtgccttagttcaaaataccgctactggtgaaatcctagttcgccacaccctcacacatgcacaatacttggaactcgaaacactttcacggacgattggcgttcaccttcatgccgaagatgatcaattcatctacacggccaaccgcgatatcagtccttatacaattggcgaaagtgccttggtcaatatgccaattaaattccgccatgttgatgaaattgctccagataaggccttttcaaaagtgatgctgattgatgatcctgaagttttagctgaaggtaaggccaagattccagctgatttcttcgatcgttaccaattcgtccaaagtgaaccttacttcttagaagtcctcaataccaaagcgggtaaaggcaatggcttacgtgacttagcaaatgctttaaacatcgaccaatcagaagtgatggctgtcggtgatcaaggcaatgacctttcaatgttggcttatgcaggcttaccagttgccatggataacgccattcctgaacttaaaaaaatcgctaaagtgattacaaagagtaaccacctcggtcaagacggcgttgcttatgccatcgaaaaatatgcactcaataaataaatgaacacctttatcgatcatttttacatcttaccgctgatcttcttagcgctgtttgtcggactgcaactgactgaaaagcgtcggtttatcaacgggattgtctttaatggctttcttgccacggcggttggtgaactggccattctcgtttttcaatcggatagtcgcaacgtttattatattgccctcgccgcagcgattgtcgcctttctgattatcttgtttttctacttgtttggcttcttactctttttatggaacgcctacatcgtttggaaaaaagaaagccacacactttcgaacatgctgaccctgtttatcgggttagggttaattgccctcttcttcgtgcctatgttggccaacttactccatgtgcccgaagatttacggattttcatcggaacaattagcaccgtttttctactttacatcccgttatttttctatctttatctttcttcactgattatctatctattcaaccgaccacggtataatcaagactacatcatcgttttgggtagtggcttaattgacggacagtacgtgccaccactgttagccagtcggattgaacgggcaatgaccttctaccaccgccaagtcaaaaaaggccgtccggcaccgaagctcgtcttctccggcggacaaggtggggatgaaaagctccctgaatcagtcgccatgcaacgctacgcaatcgaccatggcatccctgttgaacagacgttaacggaagaaaaatccgtcaacacacttcaaaacatgcagttttcaaagcaaattatcgaagccgatacggataaagataaaccccgaattatcttctcaacgaacaactaccacactttccgtgctggactattcgctaaacaagcccatctcaaagctgatggtattggcgctaagacgtcgaaatacttcttacccaacgcaaccatccgtgaattcatcgcgattctctcgatgaaacgccatcagttattatttgtaacaatctgcagtttactatttgcgattctagcagtcttattgaaccatcttaattaattatgctcgttgtttacgaatatagtgaatccctagcgtaatcaagattgttccgaagacaatgcccgcgaacacaagattgggaatttcaatatcaatcgctggaattgataagaacaacttcaccgcgatgaagagaatcaagatatacgccatcgggtttaattctggaatcttttccatcaaacgcgcaataatctgggcaatcccccgcatacagataatcccaatcatcccaccaatcaagacaatcacagggttacttgaaatcgctaatgaggctaaaactgaatcaatcgagaagacgatatccattaattcaattgagataaccgtccgccagaaacgatgtgggctactaattttagaacccggttttttaacttgcttaggttgtttttgtttcctgaaataagcatagactaagtaaactaaatagagcgaacctgcgactttgatctcccataagtggatcaagaaagtcccaacaccaataatgataaagcggaatagataagcgccccacaaaccataaactagtgatttttcctgttcaatttttgttggtaaactttgggtttgtgcagctaacacaaccgcgttatcgactgatagcaagcattccataatcaccaatgttaaaatcaataaccaatcttcagaagaacgaataactgtttgccagttatttaattcaaagaaaggctggtacaattgtacaatccaattcatatgattaaagaatttaaagaatttattatgcgcggcaacgtgctagacatggcagtcggggttattttgggggctgcacttaagagtatcgtagattcattaactaaaaacttaatcaatccaattatttcattattcgtcggtcaagtggatctttcagggattgctgtcacaattccgggaactaaggctgttttccaaattgggaacttcctcaacgacgtgattaacttcttgatcatcgctattatcgtcttcctaatcgtcaaaggattcaacaaacttcgcgacatgggcaagaagacagaagaagaagttgctgaagaagcagcacctactcaagaagaactatacttgaaggaaatccgcgacttgttggcaaacaaggatcatcaataatcacaccatgaaataaggagctgggacaaaagtaattttgtcttcagctcctttttcgatatccgaatattgatgatataaacgtgttctataagtcatttactttttaagtttgtggtgcataatcgtatccactgtttgcttcattcgccaattgtattgctcatcttctaaaagtaacatcgccaaaatatcgataacataggtcagcgcaaattgtgagttcacaaaccgcgcactggcaaagccaatgctatcttcaacaaacaacgtcaagtcactcgcagctgccaatggactatcagtcccactggtaattgcggccgttttagcaccattttcccgcgcattttggaccgcttgattgacctcttccgtattaccagaatttgatagaccaatcactaaatccgttttgttaataatccgagaggtcatcaacatcatatgactttcagtcacaacagtcgcttgaatgcccattcgggttaatcgctgcccaaactccgcggccgtatagcctgaactacccaaaccatagataaaaagctgctggctggttttgatccaactaaccaactgatcaaggtccgcttgtttaatccgtgcctgtgtcttagtgatgacatcttggtagaattgataaatttcaacggacgtttgcgattcatgatcaacctgtccttgaacccccgtcatcgttggttgggggccctcgctaaattgcaatttaaaatcgacgaagttttgacagccaatcttacgaacaaaccgcgaaatggttgaattactaacttgcagttcagcggctagttcatcaatcccaatccgctgaatgctcgcccctttttgaatcaccgctagggccaccttttgttcttgtggcgataaaaaagaatattgttgtttgatatgctcgataattgccatttatttaacttgaatcgcgtcgacataatgcttagcaatcaactgcggacgtgtgatacttgaacccacgacaacgctatggcaaccgagtttaagaacggcggccgctttctctggagaatcaattttaccttccgcaatcactggtactttagataacgccaagacctttttcaagtagtcaaaatcattatcagcaatattacagcctaccgttgctggtgtataaccatacatcgttgtcccaacaagatcaaatcctagtcggttagattcctccacatctgccaggctcgctgtatcagccatcaataatgtttcgggatactcagcacgcatcgtggcaacaattgtctctaactgctcaccattggggcgtgggcggcctgtgacatcgcaggccacaaccgctgcgccagtcgctgcgattcctcgcatttctttgagcgttggtgtgatatagattggtgcatccgggtaatcgactttatctaaaccaatcacaggaagtggcacggtatccataatggcctgcacatctacaacagaattcgcccgaatggcactggcacccgcttcatatgccgcctttgccatccgcgccatgataaatgaactatgaagtggttcatccgctaatgcctgacatgagataatgagttgtcctttagtcgtttctaagaaatgatttgccatttaacgtttaaatctattttcgaacaatggactaactggtttgttttcatggattcgtttgatcgcatccccgattagtgggccgactgaaacttgaaccatcttatcaattagtttttcttttggaaggtcgattgaatctgtaacaatcatttgcttgataactgaatcttcaatacgttggatagcaggacctgataaaacagggtgtgtacaacaagcaaagacttcagtagcaccggcatcttttaaagcttgtgctgctaatgtaattgtaccagcagtatcaatcatatcatcgataatgattgcgcgtttaccattaacgttaccaataatgttcatgacttctgagacattaggtcttggacgacgtttgtcgataattgcgattggtgtcttcaagaagtcagccaatttacgagcacgtgtcacaccaccatgatcaggtgaaacaacaacggcgttttctgccaaatcgttgcttaagaagtaatcagctaataatggtgcacccattaagtgatcaactggaatatcgaagaagccttggatctgtacggcatgtaagtctaatgctaaaatacggtcagcgccagccatcgttaacatgtttgctactaatttagcagtaattggttcacgtgaacgggccttgcgatcttgacgtgcgtaaccatagtaaggtaacacaacgttgattgttttagcagatgcacgacgtaatgcatcaatcataatcaagatttccatcaagttatcattaactggtgcagatgttgattggattaagaaaatttcgtcaccacgaatactttcttcaatattgatctgaatttcaccatcactaaaacgtttaacagaagattttcctaaaggaaccccaacttcagctgcgattttctcagctaagggcttattagagttcaaagcaaagattttcaacttagggtcgaaatattgttcagacatctagaaactagtttttttgtcgataatacaattcttatcatttagtttatcagtaaaattatgaactctgtagatagaagtataccactctccatagcgtccaccaaccgaatcaacacgaatcattttcttatcaccaatttggatattccactggacatcatattttttatttcgaaatccttcaccaaattcatcgttagcatgccattgattttcgtctgcgatacgcgttgcttcttcctctaactcctcatcactaagtttccctgtattaattgccatgctatgcggtgcaccatgtactgtattatcttcaatagagcgatataatactttatctggagcatatcccttactaataatatggacatcaacatcacctgcatcggtctcttcacgaaccatcgtttgtttaccgattttttgactccataccatattcccgtctttagtattcctatgtgttccgtatttcttgtccgcttccgcctctgtcatttcacccattttaaatgcaacagcttttttatcagccttcttgcgatgtttactaattttagatgaagcctgcacatctcgaactgatacatcaactattgttgtaataactactgatgacatgaatatggctgtaactcctaatactactaaatttcctttagctatatttttcatctattgccattcttcgtcttttgcgactggcaatttagcccagtaattttctttgtttgtttgacgtgcacgggcgatggccattgctttttctgggacatcgtctgtgattgttgaaccagctgcgatgaatgtgtgatcagcaatttcaactggggctacgatgtttgagttgctgccgatgaagacatggctaccaacgtttgcatggtgtttagccacaccgtcgtagttaacaaaaacaacgccacaaccaacattaatgtcagtgccaagggttgcatcaccaacataacttaagtgaccaatcttcgtgcggtcgccaattttagcgtttttcacttcacagaagttcccaacatgtacatccacaccgatttcagcgttaggacgcaagtggctgttaggaccaatatttgagcctgtatgcatgattgctgattcaatggttgaacttgtgatttgaatattatcttcgattgttgaatcaacaattgttgagccagcaccgacgaaacaatctgaaccgatcgttgtgttgccttttaagacaacattaggttcaataattgtatcgttgccgatttttacaccgacttcgatataagtgctttctggatcaatcaatgtgacaccatttcgcatatgtgctgtgttaatccgttgacgcatcactttggtagcttgtgatagggcaacgcggtcattaacccccattgattcttcgaagtttggcatcttgtaagctgctacaatttcgcccttcttcttcaagatttcaaccacgtctgtgaggtagtattcaccttgggcattttcatttgtgacttcatgaagtgcttggaaaagtgtcttgttatcgaaacagtaaacacctgtgttaatttcattaacagcagcttctttatcatttgtatctttttgttcaacgattttttcaacgatgccaatatcgttacgaataatccggccgtagccagttggatctggtgctgtggccgttaaaatagttgctttagcgcccttgtcatgatggtaagcaaatagcttttcaaaagtgccagctgttaataatggtgtatcaccactgaccacaattgtaataccatcttggtctttcaataaatcttcagcttgtaaaacagcgtgacctgttcctagttgttctgcttgtagggcatattgtgaacgatcacctaaataatccttcaccttttctgcgccatgtcccacaattgtgacaactgttgcaggtgctgttttttcgacttcggttaacacgtggtccaccattggtcgaccgcaaacttcgtgcaataccttgtataattttgacttcatacgagtacctttacccgctgctaaaataattgcatttttattgaccatatgaaaaaaagcccttcacgtctttggttaactctcggtggcctgttaatcttattattagtggtgcttggtattaattggtctacttcacatcaccaaccggctaaaccaactgcgagtgttactcattcacaaacagcaccagtgaaacaaacaactaaaaagcaaacttctaaaaaaacgcttgattggcacgccccttctgaaaagaaaccctatccagatgttaagaaatacgcacatttttggattgatgtttcaatcaagaagcaccgcgtctacttaatggacgatgaaaagcggctctataccatgcgtgcttcaaccggcacgagtgattctccgacacctaaaggtacctttcatattcaagaagaacacggagaagccttctttaatggcaattctggtgaaggggctaaatactggcggtcgtttttagatcacggtgtctaccttttccacagtgtcccaaccgataaagcagggaatttcctccccgatgaagcgcaaaaattgggtgaaacatccaattctcacggctgtatccggctatcggtcgctgatgcaaagtggttttatcaagcaatcccagtcaataccaaagtcgtcattcactaaatgtcagttacgattcaaaaaaagattgccacagcgtttaaggcgcttatggttgataccccatttaagcaaattagcgtgacgctcattatgaccacggctggcattcgccgccaaaccttttatgattattttcctgataaatatgccttgctgacttggatttacgatcaagaaatcggcgaatacgttgctgatcacctgacttaccctcactggaccattattttagaacaactactgacttattttgaagacaaccgcacgttctatcaaaatgcgattacaattaatggtcagaactcatttgaaacccactttaaccaccatctacggcaactcgttcaaattattatcaacgatttgacgcagctacaccatttaacgttatccccaacttatcaacaatttctacttgattacctctcaggcgcgattgttgcctataccgccagttggttacgcacagatcagccacaatcaatccaacaagttagtgccgccttacaaatcacactaaccgataccatcaatggcctcttattacgtactggccacctcgatacaaaaaaagagtatgaagtcggctaattaagaaagttgttctgcattcttcgttaaatagttaccagcgctaacactgagcgccttgttttcaatatcgactttatcaaccttcaaaattgatgtgtaatcttcaaccatgcgattaccttcaaagacagattcagcaaatacagaaatgccaaccatttcagaatcgaattcttcaattaagctcttcatcccgttgactgtgccgccgcctttcatgaagtcatcgacaattaggacttttgagttttctggtaaacttcgttttgaaagttccatcttttcgattcgtgctgatgaaccagaaacgtagttcacgctaaccgttgagccttcagtaatcttagagtcccgacgcacgataacaaatgggacgtttaagaacatcgcaacgctttgggcgattggaatcccttttgtagccactgtcattaccgctgtcacttctttgccaacgtattggttagcaattaaccgaccaacttggcgaagaacttctggacgacctaataaatctgataaatagacatagccccctggcaacagacgatcgttttcagaaagacgttcggccatttcagcgataaattcttctgcttcagcttgtttaatcattggcatgtaacgaacaccaccagcagcgccgggaactgtttctaaaatccccgtcccgcgattgaaaaaggtccgtttgacgattgataaatcttcactgatagatgatttagctgattcgtaacgatttgaaaagaacgtcaatggaattaatgtatgtggtctttccaacaagtaccgggtcatatcaattaagcgatcacttcttctaactttcatttatttttttaatggttgcactagataaacttcacgacaaaatccggacatactgttataaatgcgttgcgcgcgtgagtactggcgacaaatgccaaaaacagttgggccactaccgctcatctgcgctttttccgcgccaaatgcggttaagcgttgcattaaataatcaatttgcggatagcgttgattggtaatcggcgttaacacattagccattgcggctgtcatttgctgtgcatcttgttgctggatcccagctaagagtcgatcggtttggggccgatcagtaatctgatcgcaattcaaggcgtgtaagatgcgcggtgttgagacacttacttcaggtttaacaacgaccatccaaaagttaggtaaatcccccaacggttggatttgatcgcctttacccgttaccagtgccgtttcactataaacacaatatggcacatctgaatcaattgataaaccgatatgtgcgagctccgctttggtgaggcctaagtgccacagttgatttaaaccgcgtaaaactgcggcggcatccgaactgccaccacctaacccggctgccacgggaatatgtttatcgatttcaataatcgcacccgttttaatatcaaaacgatgccgtaataattgcgccgcctgatacgctaagttccgtttgtcctccggtaaataccccttagaggttctaacctcgatttgaggtgagtcttgcaatgtgatttggacgtaatccgccagatcgattgacgtcattatcatctgccattcgaattccccatcagtatgctgataaagtgcatctaaacttaaattaatcttcgcaggtgccttttcaatcaattgcatttaattttcttccgccatgactttttgtctgaactcattcattaaaaataacatctgtttagcattttctttgccaaaggccatcatccacgatgaaaaacgttcctgaaccttcggtaataactcactcactgtttgttgaccacttggtgtcagatttaaaattaaccgtctgcgatcacttgggtcagttgattgcgaaatatagtccaacttcaaaaggacccgaatttggcgtgaaatcgcccctcgtgttacaccacgcttcttagcaatatcaattaaactaaccgagctatcttccgcaatctccttcataatcagaaattgttcgaaagatagcttgtaagccttagttggttgcgacacgaggtcttcaacatacttaatggcagacatataaatctcaacatactcatccaataattgactatcttccacctaaagtacaattggttcttcatcaaattcaatcgcaatcgatttagttaacaaatcagcatagctatatgaaacacgttcgaacgcattttcatcttgatccaaatcaactacaaaaacggcaggaaaggtttctcttaagattccttttcgctttgttactttcttgcgcccagcttgagcgacaaccattaacttgtctccgatatgcccatcgagaccgttcttaatattggcaagtgtggttggcatttatcccctttttttagcaaaaactggttgttcgttcaagcaatcactcaattgtgcgaattgttgaatactcaactgttccgcacgggtacttggggcaatatcagcttgatccaatgcagcgactaaccctgctttgacttcttcttgttttccaaattggttttgtaaattattccagagtgttttacgacgttgcgcaaaagcaccgcgaactaattgatcaaataattgttggttttgaacagtcaccaagggttcttgacgacccacaaattcaacaatcgctgaatcgacgttgggttggggcacaaaagctgtcttagggacaataaaggctaatttaacttcagagtgcaattgaacagcgatactcaatgaaccataagcttttgaacctggtgcagcatcgattcgttctgcgacttctttttgcatcatcaagaccatgcgatcgattggtaaaccggcttccaataaatgtaacatgattggtgttgtgatgtaataaggtaagttagcgacaattttaaggttgtgttggccatcaaaatgcttggcaatcaaggttggcaagtcagcttccaagatatcttgatttaaaaccgtcacattatgataatgatttaacgtatcctttaaaactggaattaagcgatcatcaatttcaaaactcaaaacttggtgcgcttttctagcaatttgttccgttaaagaaccaattccggggccaatttcgataacgtcatcatctttagtaatctcacccgcttcaacgatttgttttaaaatcgtaatgttggttaagaagttttgacctaaactctttttaaatttaaaaccgtaccgtttaaggatttttctcgtacgctctgggtttgcaatgtcttccatttagtctcctaattcttcgttaatttgtcttagtgctgcgccaaattcgtcttggctcacctggaacattttaaggcgcttatacagttgtttactatttgtgtaaccaatatgcaagacttcccctaaacgttcacgacgggccttggcagacggaccagcaatcaagccggccaccaataaatcagactgactaatttgttcgactgcatcttcatcttgcgtcaatagattttcgagtgcttgtttaatcgccgcgggtttagcatgttcaatccctaagctaccacccattttttctggtttagcttctgaacggggtaaaaaggcgtgttcaacaccaggcacgttttgtgagataatcttacggattttttccccatgaaaatcgggatcagtgaagacaatcacgccacgtttttcttgggctaacgcaattttttcaacaatttcatcgttaattgcggaaccacgggtttcaattgtatcgacatccgggaatacttctcttaatcgtttggtatcatcgcggccttcaacaacgatgacttcttgaatcgtttttttcattcatattgctcctaacttaaaaatacggtgcgcatttgcatacgtcgctgccgcaatttcttctggtgcgacctctctcaacttggcaattgcttcaaccacatagcgcgtatagcctggttgattttgcttaccacgataaggcgtgggtgttaaataaggtgcatctgtttcgactaacatcacatctaacgggcatagtttggctgcttcatgcacttcacgcgcattcttgaaactgaccacaccactaaatgaaatttgcatcccaagatccataaaccgtttcagccattcagaatcgccgttaaaactgtggataattccgccacaatcacggacatccgtttcttttaaaatcttgtaggtatcttccaaagcatcccgcgtatgcactgaaattggcatgtgaagggatttggcgatttcaatttggcgttcaaaaacagtccgttgcacgtctcttggtgacgtatcccagtgatagtccaagccgatttcgcctaaagcgactacttctggtaattgtaattgttcaattaattgtgtttcttgggccttcgtataatcctttgctgattctggatgccagccaataatagccgataacgctttgtattgttgtgctaaacgtagcgcaccgtcatttaagaccgtatcagaacccacaattgccatctccgtaacccctaggtcagcggcctgttggataaagtcggcttcttgaccggcatatggcgtatcgtttaaatgcgtatgtgaatcaaatatctgcatttaaccaatttgtgaaccattcactaagttgctaggtacaactaccaattcaacatctgaaccgtgttctgctgaaagtaacatgccttggcttaattcgccacgtaatttacgtggttttaagttagtaacggctaagactttcttaccgactaatttttcgaaatctgggtagaattctgcaatccctgagatgatttggcgatcaccttgatcaccggcatctaaccggaatttcaagagtttatcagcgccttccaccttagaaacagctttgatttcagcaacccgaatttctgattgatcgaaatcttcaaatttaatcgcatttttttcactgactaattcagtggcctttggatcaaagtctgcgacttcttctgcagccgcttgtttagctttcactttttcgttcaccaaaccagctttttgagcagccatcatttgttccttgatataagcgacttcttcatctaaatcaagacgagggaagattggtgtgcctttagcgattactttaacagcttctgggaagttaccgtaaaccatttcgcgttgtgcttcttgatcaaaatcaaggcctaattgcgcgaacatttcacgtggggcatgtgtcatgactggttgtaataagagcgccacaatccgtaagctttctgctaagtgtgctaagacgctatcaagttcagccttgcgactgtcatctttggctaaaacccatggttctgtttcgtcgatatatttattagcacgactgattaattgccagattgtatcaagcgcatctgagaatttcaattgatccattaaagttgaatattgggcaattgtttgcgttgccgttgcttgtaagtcagcatcaaaagctgtgacgttagcttgataacttggcacgtgaccatcatcgtatttgttgatcattgcgactgtccggtttaagaggttccctaaatcattggctaggtcgtaattgattcggctgacgaaatcttctggtgtgaagacgccatcgttaccaaatggaatggcacgcattaagtaataacgaagcgcatctaagccgtaacgttcaactaacatttcagggtaaacaacgttccccttagatttagacatcttaccgtctttcatcaataaccaaccgtgaccaaagatttgttttggtaatggcaaatcaagggccatcaagaagattggccagtaaatcgcatggaaacgcacgatttctttacccaccaagtgaacatcagctggccaatatttgttgaataattgatcgtcatctgaaccataaccaagggctgtgatgtagtttgataaagcatctaaccaaacgtaaacaacgtgtttgggattacctgtgacatgaattccccaatcaaatgagatccgtgaaactgataagtcttccaaaccaggtttgatgaagttgttgatcatttcgtttttacgtgatgatggttcgataaaatcagcgtgttcttcatagtatgctaataaacgatcggcatacttgctcatcttgaacttgtaagtttcttcggcaacacgttgaacttcgtgacctgaaggggccttaccaccgatgaccttaccgttttcgtctttgtagacttccgttaattgtgattccgtgaagtattcttcatcagaaacagaataccaaccttcgtattggccaagatagatatcaccttgttcaactaaccgatcaaaaatcttttgaacagctttcacgtggtaatcgtctgttgtgcggataaatttatcgtttgaaatttcaagcgtcttccatagtgcttgaatttcttcagccatcccgtccacgtaagcttgtggggctagatttttttcagctgctttttgttcgagtttcaaaccatgttcgtcagtccctgttaagaagaagacatcaaaacccatcaagcgtttgtaacgtgcaatgacgtccgctgcgatggtcgtgtatgagttcccgattgttaatttaccagaaggataatagatgggggttgttacgtaaaaagttggtttcttgtctgccatctaaaataacgacgtttgttccgggcctttaggtgctaaattttcaaatgtaatccctaatatttgttgtaaggctaaggcgttatcagcggcatccccaccggaattattattgaagataatagcgactttcttagcctgcttggttaagcgttgaaccgttgcggcaaactgctgcaattcatctgcgttatagcgataaagggtccgttgtttgcgccacattgcgccaggattctgccaaccggccatattgcgcccatgcaaccggagcatcgcaaaatccggattcgtcacaaccggttcaaacgggacactattggtgggcgtctgcgcttcgtcagcaattacatgtgtcatttttaactgttttaaaaaagcgaacatgttctgcttatacgcttcatcgtaccaagtgccattacgaaactcgaccgcaatcggcacatcgggcaaccacgtgcgaatccgtctcaaatactgcacattttcctgattcaattgaaaaaacggcgggaactgaaataggaccgccgttaattgccccgcatctaaaagcggttgaatcgattgtttgtaacgaacaaacaattccttttccgtactagtgaagtccgtgtaatcttcctgtttggtcatcgccttatgggctttgacgataaattgaaattggtgcggtacctgctgcagccacttagcgctaacggttggtgcttgtagcgcataataaaaactatcgacctcgacaattggcaagaattgcgcgtaatcgttcaacgtcaactgctttttctccggcattagggactggtgctcactccaagtcgttaaaccaatcgtgatcatctaatagcgtttaaattgttgcacaagttgtttttcttgttccgtcaaatcttttaaagtctcgattaactgttgaccgacctgcttatagttagtttgaattcgcgttaagcaaaattcaatcactaataaaaggaccatcaattcaatcgctcggccttctgtaaagttaacgcccaataagttcacttggctgtcggccgtaaagactttaataataatatagagtgaaaataactcttcaatgaccctaaagattctgaggccttgtaatttacgtttcaatacttggagcaccatcaaagtttgttctttcgtcatcatttaattcccctcctcaatcggaaatgcttcataggcaattaattgttccccgtgaaaatcggtgtagtaacgtttaacatttttggcgagcacttctggtaaaatcactttcaaatcggcaacaataccgcagttttcttcagataaaacccattgctcatcgaatagttgtaagatgccttcgcgcgtgccaaccggatagagcggtaactgcaccgattccttaatctccgccaaaaagacatcaatcccggcgataaactcaccgtcaatatgccagtccaaccaccccgtattatacaaggtatactgattctgattgagacccgtttcttcaaaaatctcgcgtcgcatacccatttcggcagtttcgtcaccctcgttcttgccgccaatcccattccaaaggccagcatagggctttttaagtcggtttaataatagtaatgtaccgcggtaacgaatcacggctaaattatagcgtcgtttagtcacttaggcttctgcttgttctttaagagccttcatttttttaacttgatactgcttagcgattaaaatcatcgtttgatataaatcaacaatgtacggttcaaacttcggttcttcaaccgcagccaatcgttggtccattaccgctttttcgcgttgaatgttggtcaaaccgatttgattgtcaaatttgatttgggcaatttcatcaaccactgccatccgttgttcaaatagggcagcaagttgttgatcaagcgcatcaattttttgatattgttcttctaacatttaacgtagtgaataaggcatttcaatttcatttaagaaatcacggactgataaatcatataagcgttggaaatattcgggtgttgcttctttatcagaaacactcaagacaaacgcattttgttgatcactcttaccaatgccaacataggccatttgttgcgttttattagctaacaagtggtctgaatgaagaatatcataaacttggcgcacatctaaacgcaattggcgttcgctcaaaaccggtgttagcgtcaataattgttgtaagttagtggccgcaaaaccaagcgtctctaacacgcggtcaaatgcaacccacaagttaatcacagctcggcgtaatgtgaacggtgaatcgattgttttccgttgtaaaacttggtataaaatttgggcttgtggataagccactggataatcagttgtccactggttatccaactgttgattaccgccatcgaaaaagacaagtgcatccaatagcgttaagacgcggtaaatcacccattgattttctggatcatctttttcaggtgtcatattatcgcggaaaccttctagataggcttgtttggtttcggtatcgacaaaaccatgggccacttgttcttgttgaataatcgtatgcactgccgcgttgtacaatgtcatcccagtggccattaattgttcatctaactgggcattttcagtcgtcacatcttccaacacttgtggaaaaccggtcgataacaataataaatggagcaattcgtgtgatagtgaataatccacagctgtcgcatctgttaataagattgccaaactgccatcgtcattcatcacgcgttgtgcctggtcgtgttttaacatcccagaagcttcttgtgcaacccgaatcttaatcggttgtggataattagcctgtacttgtgcaactaaactttgaatctctggtgaaaagtcattttctgtcatatgacagaaccagaacaccgcaaagtgattttatatctcgcgcaaagtttagacggctttattgctgaaaaagatggcagtaccgcttggctatccgcacttaattcatcagaatccgatgccgctattcaaagcttttaccaaggtgtcgataccattattatgggccgtaaaacttatgaacaatgtatcaaactggctgggacctatccttatcaggaaaaacaaagttatgttttttctaaaacactccacgataccgccgaccgcaccaatgtggtcaccggtaatgtgccagaattcgtccgccaattaaaagcacaagatggtggcaatatttggttagttggtggcgctgaaacgttcacaatgctcttaaaagcacaactagtggatgaactaatcatcactatcgctcccgttttactaggcgacggtatttccctcatcagcacccacttaacggacatgccattagaattaagtaaaacccgccaactaggccaattcgtagaactaacctataaaattaattattaaatgacggatattcaatgcgtcatttttgattgggcagggaccacaatcgattttgggagtttagatccagtattagcatttcaaagcgcgtttaacgctgccggtattcaaatcgacactgccagaattagacaagatatgggcatcgaaaaacatgaacacattgccaaactcgctaaaatgccagaggtgcaacgcgcttggtttacgaaatacaaacgcgggattactgatgctgaccaattgcaactttttaactacttcgaacaattcttgctcaatcgcttgagtacagaaacaacactgacccctgcggttcttcaagttcaaacttatttaaaagcacaccatatccacatcgcgacaacgaccggctacaccaaagcaatgctcgcaatcgccgctaagcaagccggactacttggttatcatcccgaactgatggtttcaaaagaagacgtcgctgctggtcggccagcacccgatatgattaaccacatcatgactgcgttcaatatcaccgacccgcaaacagtcgttaaagtcggtgacaccgttattgatatgcaggaaggcaaaaatgccggcgtcttaaccgttggccttatcgaaagtagtagtcttcttggcttaagccaagccgaactcatcgacttacctcaaaaaacaagaattgctaaatttgcagaaatcactaaaacccttaaggaagctggcgctgactatgtcattcataatctcagcgaactaccggccattcttgcaaaatatcaaacaccacaaaaggagcacgcctaaatgaaccaaccgtatttacttttaacccccggcccactcagcacatcagccgctgtcaaagaagccatgcaagtcgaccttagcacctgggatcaagactacctcgccatcaccgaagatatccgccaacaattagtcgcactcgcccaagcaaaattagacgactacaccgctgttttattacaaggcagtggcagctacggcgtcgaagcggtcctcaacacggtgcttcctaaaaaggatcaacaggcttatggctgtttgatgattgccatcaacggcgcttacggcaaacgaatggccgagatggctgatcgccttcaaattcaacacgttgacctcaaagtccccgaaacggaaccaatcacccttgaattagtacaaaccttctttaaaaagcatcccgaaatcacccatttcgcaatgattcactgcgaaacaaccaccgggattttaaatcccatcgatactattttcccatgggtcaaagctcaaaacgtcaccacgattgttgatgccatgagtagttttggcggtattcccattgatgtgccaaccttaggcattgattttctaatcagcagtgccaataaatgtatccaaggtgtccccggtttttcattcgtgattgccaactgtcgccaattagaaaattgtcaaaatcgttccacttctgtgtcacttgatttatacgcccaatatatcagtttcaaagaacatcccggtaaatggcgcttcacatcccccacccataccgtactagccttccaagaagcccttcacgaactcgccctcgaaggtggaattgaagcccgccactgccgttatcgccaaaatcaaacaaccttagttgctggcatgcaatccctaggttataaaaccatcttaccaactgactaccaatcaccgattattaccactttcaaaatgcctagcgactcatttgatttccaaactttctatgacatattaaaacgccggcacttcgttatttatcctggtaaaacaactaaagtcccatcattccggatcggaacgattggcaacgttgacggcactcaaatcgctactttattagaaaccatcaaaacagttcaacaatacttgtaattgaaaaaaaagttatctgccctattcgccttattatcaatcctattgattgcgacactggccggttgttcttcaaaaaaatcagccagtagtaatcaaaccttaacaatggtcttttatcccaacgaatctgctaaagacttcaacgcttcgcgaactgccattaaacaacaactcaaaaaggctactggtaaaaaaattaagattcaaacaaccactgattacaacattgcgattgaagccatcgcttctggcaaagcccaattagctttcatggggcctgaaggttacgcccaatcacatcttaagaacaaagccgttcaacccttatttgccctttccggcgcttctggtactttaaaagacgctgcttaccactcatatttcatggtccccaaaggcaaagaagcccaataccaaaataatggtcaatacagcatcgacaacattaaaggtaagaagatttcatttgtttccgtcagctcaacttcgggtcacttgattccagttgccgctatccaaagcaagttcaacttaaaaaatagtgacgaactttctcaaaacggtcacttcttcaaatccgtcctcttcggtaactcgcaccaaggttctgccgttaacctcttcaacggcgatgctgatgtcgctgttttcgacgatattgataccaacgcttatatcaacgtcgctaaaggttcatggactaaagtcggttcagaattccgcgtcaaagacaatgccacggcgccattcatcagcgttcgtggtaaagaaagtgttgcgattgccatcagccccgttcaaaatggcccattcgttgcaaacactgataaattaagcaaaaaagatcaagaaaacatcaccaaagcatttacaagcaaagcagtcactgacaatcctaagattctttccccaaaagacgcccaagtgcctgccatctggaagaaagaatcaagcaaatcacaacttttaaaggtaacaaacgactggtatgcacctaccaataaactcgttgctaaaaattaaatgttatcggtcaaccacatcaataaaacttttgccactggacgccaagcgcttacagatatttcattcacagcaaacaaaggtgaatttatcgcgattattgggccttccggtgccggcaaatcaaccattctacgtagtatcaaccgactaatcaacaccgatagtggcgaaattagcctcgacggacaagatatccgccacgcaaagaaaaaagaactccggctaatccgccgccagattggcatgattttccaaagcgctaacttagtccctcatttgacggtcatcgaaaatgtccttcacggtcgccttgggtaccaatcaacgcttcgcggcgtttttggttggtactcccaagttgaaaaggaagaagccgtcgcattattaaccgcagttggcttggctgattttatgtataaccggtgtgatgaattgagtggtggccagatgcaacgggtcggaatcgcacgcgctttaatgcaacatcccaacctattactttgtgatgaaccaattgcctcactcgatccccagtctgccaaaacggtaatggattatctccatcgtttgactaaaaaagccaatatcacttgcatcgttaacttacatcaaatcgatgctgctcgagaatacgcagatcggattctaggcatcaatcaaggtcacctcgtcttctcaggaatccaggatgaattaaccccaacggttcttgaacaactctaccaagatagcgaggattagatgactgttcaaaaattctttagaaaccgaaacttagcgctgattgccatcgcggtattgcttagtggcctctatttttcaacagccacactaatcgactatcatctagtcagttcagtcaaggcgatcccagccgctatcatttggatggtcaccaactttatgcctaccagccgcgccattgcggcactccccgagattgtgactaaatttacccaaaccgtcactctttcaattgccgccactttagcggccgctttcttggccctaattgtcgctctgaccggttcagaaacgactggtatcaatcgttttacgaagttattcgcacgcatattcgcatcgttttgtcgcaatattccgctaatcgcttgggcgatgattttactcctcgccttcaagcaaagcgatttaaccggtttgttggccctttttctagggtccttcggttatttaacccgggccttcatggcattaattgataccaaagcaactaatatctacgaaacactcagcacaactggcgccaactacttacaaattgtgtgccaaggcattctccctagtatctcgtcttctttgttaagttggattctctacatgattgaaaacaacattcgtgatgcgaccttagtggggattttgactgggaccgggattggtttttcatttgatctttactacaagagtttccgctttgacctcgctgggatgacgacactcgtcatcattgttggtgttgtctgtgttgaactattatctaatcaagtcaggagattaatgcgatgaatgattgaaacaccccgtaaaatcgtaacacaacccgaaatcacgccacctacggctaataaaattttagtccatccttggaatcagcgtcgtaaaaccgtcgtcattaccttctttcttttggccgtcattagcttgtacgaactaatgaccctttcaacaggtaacgttcaattaccgaccgccttcaaaacgttgggtcaaaatatggccttaatcttcttgcaaccgagcttaaatgggagtgatacgtttccccaattactccgcgctttactcgatagtgtcgcgctcacgacactcacgaccttactgggtgccatctgttctttcttcgtcggcctattagccgctagcaacctttctaacccgaaaattgggaccgccattcgaaccctaatggcaattatccgcgcgatcccgaccattttatgggtgctaatcttctcgattgtgattggacttggtgctgacgcggccgtaatcggcctaagctttcatagttttgcctatctcacaaaagcctattcagaaagtttcgaaacattggacaaaggaactatcgaaagtctcaaagcgatgggcgctagttggtggcaaattgttttccaagcgatcttacctaccagctttgccgctttactctcctggacattcattcgttttgaaatcaactttactaacgcaattgccgtgggtgcggcggccggtgccggtggtatcggttatcaactcttcaccgccagtggcttttactacgatttccacgaagtcggcgtgattgtttacctctgtttagcagtcactgcctgtttggaattcatttccattaagcttcaaaaacgttacctctcaaattagctaatccttatcaagatattgtccatttttcgtgtaggtcactaaagttgttggcgcggcacctggaattaacgtcttttgcttagcaaaatcactgatttctttttcaggggcgctgttcccactagtagtcgtgcgttcaaattcaatattattaaaaatcagtcgggcgtcgtcgagagctgtgcgctgtggtttcttatcttgatcgagataggtaccttcaaattgctcaggttggctcaccgttaattgccaactattgattccccagtaatccgcaattccaatcgaatatggctttttctgcccattttgatccttagccgttggtagataatacgtacgttcagcctgtgtattcgagaattttccaaatgagaatttcactgggtgggccattatttcgagtcgctgcttctcatacctgaaaagatagactgtctcggtctcatcaaagaccggatcaacatcccgaacatggttatcaaaagtcggcacactggcattaccatcggcggtaaagtcgaccggcacataactatcgatataagctggtcggattcgattaatattttgcccaccactgacttgaatttcatccgacttaacttctgaaagacgtttaccgattggtccggtaattgtaatctgctgatcgccgattggctgtccagtagcccgatcaagatatttgaagattacctttccgattttaggtttggtaatcttcacagaagcactggcatcaatcgttagcgcagtgccattgacttctttaccagtcacctgtgccgtattctttaataaggctccgtcatcaaccgtatcagcgacctgtgcccgataagttaaggttgctgtttcacctgctaccattgattccagactaattttcccgatgtcactaactgatttcgtagttgtctgctgtccgtattttatagttgccgaattaggaactagcgttaatccctttggcagttcatcgctgagcgttccttctacaagaccaccatcagaccggttaaccttcagaacaacacggtaatcaagtactcccttgaccgcactttccgccgtttgtccgtaatcaccatccggatctgctgcattacgtaccattttttcgatggcggttggttgatcttgaaccggaatctgaacgtcatctgatgcttcgttaggaaagccattttcacccttagcgatcattttcggcgtcatcgtcgtacccgccgcacttttattgatttgggcatcgtacagaacgcttgtccattcattttccgccaaagctttcggcaatttaacactcacttgaccagtctgtgcatcataatgactcgcatcaaccgcctggattgtctcatcagctaatttcaacttaatcgagtccgaatcgattgttaagcctttaggaacgtcgaccctaaccgtcacgccttgccagtcactgttataaccattattatgcgccatcgattcaactgtcagctgatcgttcacatgattctttccgctgtcactggtcttatttgtatatttaataaccgcatccgggctaaccacacctgattcggtcaagccaatatcagaacgataatgatatacagtgttcggctcaaaagtttgccaagaccacttattactgtacgtagaatccagctttttaaaaacagcagtaccctcttttagattatcgctttctagtccagggctatcaaaatccgttcctttatatggcgataaggcataactatatgaatcaagataactaccagtaccgtagtgttgcggaccatccggcactttaacattgataaaaactttgtatttcttactttgcagatataatccagcattattaccttgtgaataaaccggaatattatcgtcataatccaccaataaatccttcgctaaataaatgccggcctcatgtttcgtatcctctttactcgccagatatagctcttgttgaataacggctttcccaggattgggacgcattaataacgttgcttcataatttttcttattaacttcaactgcaccaacggctttgagtgcaatactaccatcactggttgaccctttatagatgctatatgattttaaccgctcaccaattgattcatttatcatggatggatttttatttgaccgatcgggatgaattgcataatcaaatgacgtaatcaaattttgtttagccccaaagaaggcagaatctatccgaccattattatttataaagatattggccttaggtgtttgccccaattttaaaatcgaacgatctgaccgactcacactcgctttaccaaaagtgtagcctaatcgacgaccgttacccaagtcgacataggcaatcgttgactgcggtactaccgcccaattctgaacaccttcatcaattgtcatagctttggcgagctttttatcgccgactgcttcagccgtttccggcgacattttctgagtattacttttctgatttgcttggctcgttgtattttttaaaatcgtttgtgttttcgtaaattgcttctgggtcgtggcggtttctctctgtccggccgtcacattctctacataaatcaccaataatagcgctatcaaaataccgaatattactaacttcattatttttttcatttatttcaagttaacgacagcgccaacttcttctaatttagctttcatttcttctgcttcgtctttagaaacgtcttctttaagagctgaaggagcgttatcaactaagcccttagcatctttcaagcctaagcctgtgatttcacgaacggctttgataactttaaccttttcttggccgatttctgataattcaacagtaaagctgtctttttcagctgctgcgtctgcgccagctgcacctgctgctgctactggagctgctgcagaaacaccgaattcttcttcgattgctttaactaagtcgtttaattctaagattgatgattcttttaattgatcaacaattgcatttacgtctaatgccatttatgcagctggttcgtctttactgtcggcaactgctttaacagcatatgcgacattgcggactggtgcttgtaatacagaaagtaacattgataataaaccgtcgcgacttggtaatgtagccaaggcgttgatttcatcaagtgttgccactttaccttcgatcataccacctttgatttcaagtgcatcagcactcttagcaaagttagcgatgatcttagctggtgcaacaacatcttcgttagaaaatgcaactgcagtagggccagagaatgtttcatctaaaccttcgtaaccagctttgtctgctgcacgacgcaagtaagtgtttttaacaacttccatttgtacgccagcttcacgtaattgtttacgtaattcagtaacttgttctactgttaagccacggtaatccataactacgatagaaacagcgttattaaatttttcaacaactgtgtcaacaatttgtgctttttttgcaatgattgtttcgctcaattgaacaatattttagttatcaatgctggtagttcatccctaaagtggcaactatttcaacaaaccgatttaagcttagtggctagcggtttgatggaacggatgaacaccccagaagcgcgctttacttttaaattcaacggccaaaaagaacaggtcgcaatcgctaatctaacctatgaagatggcgttattcgtttattgaaacaattacaagacaatgccattattgactctcctagcgacattgtcgcagttggtcaccgagtggttgccggcgcaacaacgtttgaaaaatcaacgttaatcaccgctgataatttggcaaccctcaaggcactcgataaatacgcaccattacacaatcctgttcaagtggattgcattgaaaccttaacgcatatcttaccaaattcagtgcccgaagtcgctgtcttcgatagtcaattctatctagatatgccagatgcaaccagtttttatggacttccttatgaagatagccaaaaataccaaatccgtaaatacggcgaacacggtattagtcacggctatatcttacaagaaacagctgactttttaaaccaaccagtcgcagatttaaaattgatcaccctacatcttggtggtggttcttcaatcacagctagccaaaatggcaaaccagtcgatacatcaatgggcttcaccccacttgaaggtcttccaatgggcactcgtgctggttcgttagatgctgctattgttcccttcttaatgaatgaattaaataagagtgccgacgaaatcatcacgctcttaaatacagaatcaggaattctcggcgtttcaggtatttctgctgatatgcgtgatatccaatcatcattggcgactaatcctcgtgccgaattagcttatgatatgttcatcacttctgctgctaaatttatcggtagctactacgttgaacttggcggtgccaatgtcattactttcacagccggaattggtgaaaatgatgctaaaatgcgcgctgatgtctgcgaccgcttagccgttttaggcgttaagattgatccagaacggaatgaacaaggccatggtgcgcgtcaaattagtaccgacgattcagctatcaaggtcttgatgattcctactaatgaagaattagcgattgccaaacaagttcaagcactcgtttaaatggacaagagagttgattctatatcagaaacacgaacgaattgggtagaacgtcaattcaaaattaaggaaagtggttcaacccttaagactgaaatcatcgccgggattacaactttcatcgcgatgtcatacatcctattcgtaaaccctacaattttaggagatgctggtttagataaaggcgccgtctttgtcgccacagcacttaccggtatcgtcggttgtttagcaatggccctcattgccaactacccaatcgcagttgcccccggacttggtagtaacgcctttttcgcctactctgttgttttaggcatgggcattccttggcagacagctttagccggtgtttttgttgcttccttactcttcatgcttgtcactgttttaaaagttcgtgaagtggtgattaatgccattcccgccaatctcaaatctgcgatggctgttggtattgggttattcatcgcttttaccggtttaaaacaaggcggtctagtggttgccagcgccaaatctttcgttaccatcactaactggtctaatccgcatgtttggttaaccgtcttcggtctgatcttaacagtcgctttactcgctcgtaaaattcctggcgccctcttcattgggttagccgctactgccatcatgggtgtcgttaccggtttaatcgcaatgccaaccggtgttgtttcttcaattcctagcctcgcaccaactttcggtgtgtctctcattcatcttaaggatgttttctcagttcaaatggcggtcgttgttctcgtctttttcttcagcgtgttcttcgacacaactgggaccgtgatcggtttagcccaacaagccggcttcatcaaagataacaaaatgcctaaagaagtcggtaaagccctcttcgcagattcaacctcaatgattgccggttccgtctttggctcaacgccaactgcttgttatattgaatcttcaaccgggatcgccgttggtggccgtaccggttttaccgcagtcgttgtcgccatcatgttcgctcttagtttattcttttcacctttattagcagttgtaacatctgaagtaactgctcccattttaattatcgttggctccttcatgattaaatcaatcgccaacattgattggtctgaatttgaaacagcattccctgcttttatgatcatcctttgtgtcccattaacctacaatatctcatacggcttggcttttggtttaatctcataccccatcacaatgattgcggctggtaagggtaaaaaagtgcatccgattatgtacgttgctgccctcttattcttagtcttactctttacaatgcacaaattacccggtaaataaatggataaatcaactttaaagcaactcatcgatcaagctgccggtcgcaaaccagccgacacaatcatcaaaaatgctaaaattgtcgatgtctataacgcccggatcatcgaaggcactctcgctatcgccgatggccgttttctgggaattgacgcagcttatacagccgacaatgttattgacgcacacggtcaatacgtcgtacccggtttgattgatcctcatattcacatcgaatcagctaacgtatcacccgccgttttcggctcactcgtgacaccgcatgggacgaccaccattctcgccgatccccacgaaatcgtcaacgtcgccggtatgcgcggtcttgaatacatggttgcttctgccaaaaatacagcactcgacatcaagtatacgatgccgtcctgtgtgcctgctgcaaatccaaccctcgaaacatctggtgctgtcattaccgcagatgagattaaacaatcttacgaccaaggactaacttatggccttgccgaattcatgaattatcccggcgtcgtcaatgccgacgatggcgttttagatgaattattagtttcacttaacgcacataaaatgattgatggccattcacccgcattacacggtcaaggtctcaatgcttatgcagccgcaggagttcacaacgatcacgaatgcacacaagttgatgaaatgctcgatcgtatcagtcgtggtatgtacgtttacctccgttacgggacagtttctaagaatatgccaacgcttttaaaaggcgttacgcctcaaaacgcacgcttctgttgcctctgtggtgacgatttacaatctgttacccttcgcgaaactggccacttggacgaaagcattcgtgtcgccgttcaaaacggaattgatccgctaaccgccattcagatggccaccatcaacacagctcaatgtaccggcctcagcgatcgtggtggtattgcgcctggtctcaaagctgatttcttattggtcgacgacctcgaacacttcagcgttaaccaaacctttattgatggtcaaaagattgctgcaaacggcgcttacttattaacaactgatgattccgtcgccggctttgatgatcttctagaaaccgttcatctcgacaatttttcagctgatcaattaaatctcaatctcatcagcgacaaagcccacgtgattggcttacaaagcattagtcgcactcaaaaccttgtcttgcctgttacacacgatgcagatggtgattttcactacaatcctagcgaagatatcgttaaagttgccgtgattgaacgacatcatttaaccggcaatgtcggggttggccttttaagcggctttggccttcaaaatggcgcgattgctaccagcatcggccatgacagccataacttagtcgttgtcggcactaacgacgcggatatggtcatggccatcgatgcgctcaaagcttgccaaggtggcggtgttgccgttcaaaatagtcaggtaatcgcaacccttccatttgtaattggtggtttaatgagtactgaatcaattgattcactcatcgcccatcaaaaagcatttaataccatttgtcatgaacaactcaacgtcactgcccaatttgatccgattatgaaactcggcgcaatgccactcgatgtgattccaaacttacgaattactgataaaggcttagtcgatgtgactaaatttgaaattattgatatcaatgcctaattagaagctagcaatatcaactttgacaccagggccaaatgttgagctaactgataaacttgtaatgtattgacctttagctgaagcaggacgagctttgatgatcacgtcttgcatagctttaaagttttctactaatttagcagcatcgaatgataccttaccgattggtgcgtgaacgataccagctttatcaacacggtatgccacttgaccagctttaatgtcgttaactgctttagtaacgtccattgtaactgtaccagtcttaggattaggcattaagcctttaggtcccaagacacggcctaaacgacctacttgagccatcattggtggtgtagcaacggcaacgtcaaagtctaaccagccgccttggatcttttcaactaaatcttctgcaccgactacgtcagcaccagcagcttcagcttgttttgcttgttcgccttgagcgaaaacaataacgcgttgtgtcttacctgtaccatttggtagtacgacagcaccacgaatttgttgatcagcttgtttaggatcaacgtttaaacgatatgcaacttcaagagatgcatcgaattttgcaaaatcaactttctttactaagtcgattgcttcttcaacagtgtatgctttagcagcatccacttgttttgcagcttctaaataatttttaccttttttagccatttaaccttcgacagtgaatcccatgcttcttgcagtaccttcaaccatgcgcatagcagcttcaacgtctgcagcgtttaggtcttgcattttagtttcagcgatttcttgcacttgagctttagttacagttgcaaccttcttagtgtttggttcgccagaacctttttgaacacctgcagctttctttaaaagaactgctgctggtggtgtctttgtaacgaaatcgaatgaccgatcctcgtatacagtaatgacaacaggaatcaataaaccagcttggtcagctgtacgtgcattgaaatcctttgtaaagcccatgatgttgataccagcttgacctaaagctggacctactggtggtgctggagttgctttacctgcaggaatttgaagttttacgatgtttgctacttttttagccacttagtcttgccacaaaaaatcactaattgcctgatcgactaaccgattttcgtgcaacatgctgtgagccccaccggcacctctgacgagcatttcttgataccggtcgattcgcccccgcaataaactacgcagcgcaaaactgctatcaacggccactgagccgtcgtgacggctagtgcccaacaattcgccagcgacattcaaaatactaattgccgttggaaaatgcgctactcgtttggccaaataattataattggccgtttttttgcgtggtccccgttgcgttaattcgctccaaaagaccgttgcagtatccggcccaatcgacggatcattaaccggtgctgctagtaatacgactgctttaactggcacggcagtcggctttaataagtaacgtaatactgtgatggcccccatcgagtgtcccaccaaattaatcgtggttacgtcgtaatcttttttcaagatagccacaatttggctgagccagcgaacttgatcctgcacatcagcgtgattattttgaaataggacttggatcgtcggattactggccgtcaattcttgtgggcctttaaacgttaaggtcccgtcggcagcaactttgataactaacgcttttttggcgacccccgttttttgcagacgcatcaataaatgccccatagaataccgattaccccgataaccgtggataaacaacgtcggtgctgtttcataatgcgttagtcgtggacaccagtgatgctgtacgtgagctaatttataataatcgagcccaattaaactcactgctgccacaactaaaataacaatgactgctaataactgattaataatctgccacatattcatctaaactaattcgtctacttgatcgtagtctaattctgttgccgtttcacggccgaacatatcgatattaacttttaacttcatcttttcgtcgtcaacttctgtaatttgaccaactaaaccagagaaagcaccatcaacgattttaacagattcgcccactttgaattcaacatccaaatgacgtgtgctcatgcctaattgacgtaaaatttggctaatttcatcgtccaataatggggctggtttactaccggcaccgtgagaaccaacaaagccagttacaccaggtgtattccgaacaacgaaccaagcttcgtctgacatcaccatttcaaccaaaacatagccagggaaagttttcttcatatcaactttatccttaccgtttttgatttcatgttcttcttcttcaggtacaacaacgcggaagacgttgttttccattcccattgattgggcacgagattctaagttcgccttaactttgttttcgtagcctgaataagtgtgtaatacgtaccagcttttttcgagtgattcaaccatttaaaaaataaatagttcaagaagtttgagaattgctaagtcaacgacgccaaagaaaattgcgtataaaactgatgtcatcacaacagttgatgtatccttacgcgtttgtttggcattaggccaagtaacaattttcatttcttcaacaacgctttttaaaaacttaatcatttaacgtgtttctttatgttgtgcgtattgtccgcaatgtttacaatatttgtttaactctagacgttctgtccgattcttgttttcagcaacgtaatagttacgtgaaccacagacagtacaggctaaggcgactttcttaacacccatttaacgattctcttgataataccgttttaacttagtctggcaccttgattggcctcgtttcaactggtcaatcgtacaatcgagttggcaacaagcttcatcaattgaaagctgcccggtcagcacccgaaacgacactaattcaaaaggcgacagcgtttcaagataacatctcaattcaaactgcgattgatagtaagtcatcgtatcttctgaaatcgcgtcgtgttccggccgctccgcaatcaatactgcctgacgatcacctcgccgtttttgtgcgagttctcgtcgtagtaaatttaaaatgtggtttttaaaccgtaatttatagaaactcccaaaacttttgcctttttgacaatcgtaacattggcaagtttcgtaacaaacaatccgggcttcttgtaaccaatcgtcttcatcgaataaccggatataatatggcgccacggtgtgatacaccatcggcaaatacgccttgaataatacatctagtgcttgtgaatcattctgagccactgctgcaatcagcagttcgtcgcgctttgtttgttccatttaatcagtcttttcgtcactcaattggtcgcgcatctgcgctaaacgttctaattgatcgtcattccacggccgattacgttgcatcaccttactgtgataacgtttagcgtcatggtcaatctcgcggtgcgtccgcttaatctcgcgatagaaatcatgcgaagatacccgcaaagccccccgcgaaaagattgtccattgttcagcttgatcgcttgaaacgacggtgacctgattaattggtgacatcaatttaccagctaaggcttcaatataactatcagcggtttcatcttcttcagtaaaaacgacctcaagattatattgctcatagctttgtttaatccctggcacatacatcgcatcaaagacgaggataatttcgatttcgcgaaacttccggtactccgataatgtttgcaataaactatcacgcgcatctgccaagtgatcattttgctttaacttatttaattcaggccaattaccaataatattataaccatctgcaattaaaatctgctttttcatctataccaaaggttgacggctattataagcctgatacatgagaacccccgcagcaacactggcatttaaactttgcacgtgacccaccattgggattgtcaaagtttgatcaacttcttttttaacgattggtgaaagccccttgccttcgttaccaatgattaaaccgattgggcccttagcatcccacttacgatagtcggtgccggccatgtcggtgccaaaaatccagagaccgcggtctttaagttttttgatttcttgcgttaagttcgtgacgcgcgcaactggaatatgttcgatcgcacccgttgacgttttagcaactgtggatgttaatccaacagcacggtgttttggaatgataattccgtgtacaccaactgcatcagctgtccgcatgattgaacccaagttatgcggatcttccaagttatccaagattaagataaaaggttcttcttcttgcgctttggccttagcaaaaatatcatcaacactcgcatattcaaacggtgcgattgctaagataatcccttggtgattttgacgatcgctcaataagtccaacttgttcttaggcacattttggatgatcaatcgtttttctttcgctaatttaacgacatcgtgtacgaagtcagctttcaaaccatcttgaaggaagattttgttaatcttcttggcgtcgcttgtcttcaatgtttctaaagaagcatgtttcccgatgacgaaatcagtttgttcttcaaccgctgcttcttctacaggtgctgctggtttcttgttagctgggcgccgtgttggcttagcagtatttttagccgtccgacgactattaaattcattattcttctgattataagattggttattattttttctcatttattttttctcatgggtcctcccagcgtcgacttgttgaatacaccagtgggctaattcagcgacgcgctcttgttgttcagttaagtatagatagccaaaaaccgcttcaaagccagttgaggtccgataagtcgaaacactcgtattcttggctttcgtataacttttggcatttctaccgcgtttaaaaatattcatttcttcttctgttaaatagttatcatcgatcatcaaaccaatcaaagcagcttgcgctttagcagacacatagtgtgttgcgacttgttgcaagcgagtaggtttggttaagccgagttctaataaatgggcccgcacgtaaacttcataggctgaatcccccatgtaagctaaggcaatcccgtttagttgtaaagcatttttcattcatgcgcgtctccatctcattccttgtggtgtatcttccaaaataatcccttgatccttcaattggtcccgaatcgcatcactcttggcgaaatctttagctgctcgagcggcttggcgttcttcaattaaactttcaacttctgtatccaataattggtccgctttaaacgcaacaccaaaaatggctaatagtcgcgttaaacgagttgccaatgacgttaatgtatcggcttgaaccgttgtctgttccaaatattggttacttaatttagcaagttcgtacaattgggttaagccgttttgaacgttaaaatcatcgtccatcgctgtgacaaaagctgtttccaattcagctgccttatccatcacaatttgatcttcgcctggttcagccgttgcttgacggaaagccaggttatcaagtgttgtcttcaagcgatccaaattagtttgggcttctgccaacaatgattggctgtagcgaattggccgccggtattgcgtactactcatcaagaaacgcaatgcttgtggattaacttcttgaatcaaatcgtgaaccgtcacgaaattaccaagtgacttactcatcttttgatcgtcatccccaaccgttacaaacccattgtgtaaccagtagttcacaaaggttttgccagtcttggcttcactttgggcaatttcattttcgtgatgggggaattccaaatcttggccgccaccatgaatatcgatcgtatcgcctaagtatttagtcgacatcacggaacattcgatgtgccagccaggtcggcccttgccccaaggtgattcccaagcaatttcgttgcctttttcagctttccataaggcaaaatcgattggatcttccttacgcaaggtttcttcagtagctgtatgttcgctggcaccttgttcgagttgatcaagatcttgaccagcaagatgaccataagccttaaacttacgagcccggtaataaacatcgccgtcaacagcataagcataatctttagcaatcaaatcttgaataaatgctatgatttcttcaagattatcagttgctcgtggattaagcgttgctggttcaatattgagggctttagtgtcttctttaaaggccgcaatgtagcggtccgctaattcaggcacggtgatgttttccacgttagccgctttaatcatcttatcgtcaacatccgtaaagtttgaaacgtaatcaacttgataaccgcggtattcgagatagcggcgaatcgtatcaaacgcaatcgcactacgcgcattaccgatatgaatatagttatacacagttggcccacagacatacatcttaacgcggccttcttcaaggggtttaaacgtttctttttggcgtgtgagggtattataaacagtaagcatttatttttcattcaagcctttttgttgatgcgctggtttggcgaaaatcatccgcccagcagcagtttgtaaggcacttgtcacaatcacatctaatggtttattaagataatgttggccatcttcaacaacaatcatcgtcccgtcttcaaggtaagcgaccccttgttgacgttcggttccggctttgaccactgtgacagtcatcgcttcaccaggtaagacagctggtttcaacgtattggccaattgattgatattaaacacaggaacgttttggaattcacagactttatttaagttgtaatcatttgtgaccacaattccgtctagcaacttcgctaacttgactaatttgccatcgacttccgttaaatcttcgaaatcaccatcgtacatttcgacagataaactttcgtccttttgtaattcattcaagatatctaaaccacgacgaccacgcgcccgttttaagttgtctgcagaatcggaaattaattgtaattcatgtaatacgaagttcggcaccatcaacgtgccttcgataaagccggtcttagcaatttccttaatccgaccatcaatgatgacactcgtatccaaaatcttgtacttgcggaaattgtcgtctactttgcgttccaagacatcggcattacgcttcttaggttgtaagaacttacgccattcatctaagcgggtcgtccccaccttgaagcctaagtaaccaagcgcaatcatcaataggattggcacaacagtgttcagaacaaaaatcggcatccggtataacggaattgaaacaacattcgctaataacaagccaattaatgaaaaaacactcccaaataataggaaactaggtgattgtttaaacaacgccttttccaattgacgcatcgcccgtaacatcggattagccaacaccaggaataaaagataaaaaataattgcacctaacacggcattggtaatgccattattgagatatgtgactaactctaaatgaacaactcgccagaattccggaaaggccgtgatccctaaagcaccccctagaattacaaagacaattcctaacactcttcttttagttaatggtttttgttgcatcatctagttgaatactttttttaaagtttctgcaatagttgtgaccccaacgacttgaatatcagttggtggatcccaaccttgcaaattatttttaggaacataaatccgtttaaaacctaacttcgccgcttcgccaacgcgttgttcgatccggttgacccgccgaatttcacccgtcaagccaatttcaccgacaaaacaatcggttggtggaatttctttatcgcgataactggaagcaattgaaacggccatcgccaaatcaatcgctggttcatctaacttaacgccaccggttgctttaagataagcatcttggtttgaaagcatcaaactcgcccgcttttctaaaaccgccataatcaatgacacccgattatgatctaaccctgaagaggtccgtttcgcattcccgaacaaggttggggtaatcaaagtttgtaactcaaccaagattggtcttgtcccttccattgaaaccacaactgctgagccagtcgcaccggctagtcgttcttcaaggaaaatttcggatggattagcgacttcttgcaagcccgcttcccgcatttcgaaaatcccgatttcattggttgaaccaaaccggtttttaacagatcgtaaaatccggtaagtgtgatgggtgtcaccttcaaagtacaacacggtatccaccatatgttccaaaatcttagggccggcaatcgccccttccttcgtcacatgtcccaccacgaagatggtaatttgattcgttttagcaatccgcatcaattctgcggttacttggcgaacttgcgaaacactcccgactgcggaagtcacttctggttcactcatcgtttgaatcgaatcaatcacgacgtattccggtttgagcgtttcaatttggtggcgaatattgcccatatccgtttcgggatacagatacaattgatcgccattaacccctaatcgattcgcccgcatcttaatttgtgaggcactttcttcacctgaaacgtataaaatcttacccactttttcaagttgccctgaaacttgtagtaacaaggttgattttccaatcccaggatccccaccgattaaaatcagtgaacccggcacaacgccgccacctaaaacacgattcaattcatttaattccgttttaacacggggttctttttggatattaacggtgctaattttttcaggttcagtggcgcgccctgaaattgtgaaatttgattttgccgctgcggctggttgttcacgttcttcaaccatttggttccaagcaccacaattcggacagcgccccaagaatctgggggaactatagccacaattctggcagacaaactgcgttttaactttagccacctagcgaccagatgaaccaaagccaccggtccgtttagttgtcacagccacttcatcatcagctacaagatatggcataaaaataccttggccaattcgttcacccttacgtaaaataacatcgcgtgggctgaagtttaacatttgaatgaagatttcaccttcgttggcatcattgtcataataatctgaatcaataatcccgacaccattgggaatcactaacccttttttcaagggattgcttgaacgattggcaatcattaaatattcatcgtcttgcatatacgccttaatcccagttggtactaggaagggtttcaacgtcttagaagcccgttcaaaatcatcatcaactagtggtttgccgtttcgaatcatccgaaatagacggacaaaattataatgccagatggatggtaaaacgaagtcctctgcacaagcaaaatcgtatcctgctgaatgagcagtcgaccgcactggtaaacttaagtttgctgattggtatttggttactatttcgaatcctcgttttttcatatggataagaatgcaatgaaaaaaatggccgctgaacgttcagtggactacgtcgaagataatatgattttaggactcgggactggctcaactgtcgtgtacatggtcgaagcactcgctaaacgtgtgaaagccgaaaacctccacctaacttgcgtctgcacatcaatcagaaccgcagaacaagcaacatcgctcggcatctcggttaaagcgctcaacgaagtcgatcatatcgatttaacaattgatggtgccgatgaagttgataataacttccaagggattaaaggcggtggtgctgcccacttattcgaaaaattagtggcaacaacctcaactcgcaacatctggattgttgatgaagaaaaagtagtcgatacaatcggccgcttcccactccccgttgaagtgattccttttggcagtcaacaagttttcaacaagttcgttaaagaaggcctcaacccagaattcagaacaaccgaagacggccaacgcgtcttaacagattcaaaaaatgaagtgattgatctgcaccttgaaaaaatcacacatccccacttactagcaacttggttaagcgaacaagtcggcgtcgttgaacacggcttattcttagacctcgtcaacgaagtcgtagtaggctcaccagaaggcgtaaaaatcttaaaagcaagataaatgacccaagaaattacacatgctaatttaatcaagatgcgccaagcactcgccgacatgccgcaagcccaaacactacgtaatgccgtcatgaataacgggattaacgcggtcgctcagcgccctgatactgccgtaacccttgatccaacctactcgatagacttgccaaccggtgatgtcagcttccaaaaaaagagtggtcgttgttggctatttgccacactcaatacacttcgtcatgatttcgaacaaaaatataacgtgaaaaactttgaactttctcaaaactacctctcattctgggatcgcattgaaaaagccaatcttttctacgaaaaaatcctagcaacagctactaaacccattacggatcgcgaagtcgccttcgcacttgccggacctgattttgacggcggccaatgggacaatgcagtcgcattaattcaaaaatacggtgccgttcccaagtccgtcatgcctgaaacttacaacagtgatttaaccactgaattcaacagtaccttaaatcttaaattacggacagatgcgattaagctccgccaattagttgctgatcaagcaccttctgacaagattagcgaaactagaacggcgatgttaagcgaaatctaccgtctcagcgtttacgcttttggcgaacccgttgaaacattcgacttcgtctatcgcgataatgatcaacaatatcaccttgaccaaggcctcacaccactgagcttctatcaaaaatatttgaatcgcaattttgatgattacgtcacagttgtcagcagcccacaagcaagcaaacaatacaaccaactttacagcttagactcacaagataccgtagttgaaggccatccaatgcgcctattgaacctcccacccgatcgtctaaaagcactcgccattcagtcacttaaagctggcgaaccaatttggtttggtaacgacgtgctcgccgacttagaccgccaaaaaggttggttggacagtaatctttatgactactcaagtctcttcagtattgatttaacaatgcctaaagaccaacgactcgattatcgccaaggcgttgtttcccacgcaatgactttaaccggtgtcaacctagttgacgaccaacccacaaaatggcaagttgaaaacacttggagtgacaaggtcggcaataagggctacttcagcatgagcgacgcttggtttgatgactatgtatacgaagtcgttatcaaaaaagaatacctcacaaaagaagaacaagccttactagaccaaaccccaatcaaactagacccatgggacgcactacaataaatggttcaatctatcacacccgaaaatatccaacaattcaaagccgacttcaaggcagttccacaatcaaacgtcatcaaaaacacagtgatgaacaatggctttttagccagcagtcaaaatacaacttcaaaggctttaatggacccagtcttttcaatcgatttagacactggtgccgtttcaaatcaaaagcaatccggtcgttgctggatgtttgccgcattaaatacgatgcgccacagcttacaagcacaattcaagattaaagatttcgagctttcacaaaattacactaacttctgggataaatttgagaaatcaaactacttctacgaaaatgtcttaaagacagccgatcaaccaatcggcgatcgcaaagtcgactttttaatgactacgccccaacaagacggcggtcaatgggatatgttatgcgccctcatcgaaaaatacgggattgtgcctaagtcagtcatgcccgaaacttataacagtgaaaaatcaagcgaactcaacagtgtcttgaatcttaaacttagaaaagatgccgtcacacttcgtcaattggttgccgatggtgtcagcgaagccgatatccaagcaaagaaagatacaatgttgactgaagtttaccggatgctcgtttatgcattaggcgaaccacccgttgaattcgacttcgaatatcgcgatgatgaccacaactaccacattgaaaaaggcctcacaccacaaactttctatcaaaaatatgttggttgggacctcgaaaattacgtttcattaatcaattctccaacagcggacaaaccatacaatcacttatacagcgttgaaatgctcggcaacgtggttggcggccgtgaagttcgccatttgaatcttgatatcgatgatttcaaacaactcgccatcaaacaactccaagctggcgaatcagtttggtttggtagcgatgttggtcaatcatccgaccgtaaacttggtatcatggatactgaaatctatcaaaaagcagcattactcaacatggacctttcaatttctaaaggcgaacgcctagattacggcgaaagtttaatgacacacgcgatggtcattactggcgttgacatcgttgatggtcaaccaacgaaatggaaggttgaaaactcatggggcgataaagtcggtactaagggctacttcgtcatgagcgacagctggtttgacgaattcgtctaccaaatcgttatcaacaaacgcttcctaacaccagaaatgcaacggattgaaaaagaagaatacgatcacccaaccgttctcgcaccatgggatccaatgggcgcattagcaagtcgctaactaatcctgtgtcccaacaactaacaaactatcgtaataaatttgcatcatcatttgccaatcgctgaattggagccattcatcacccttatgcgcgatacccttttgtcctgggaaagaaggcccaaacgcgatgatattcggcaaagcgcgggcgtaagtcaccccggttgtcgtcaccggtgtaccatctaaacctgtatcagccgcataaatcgccgataactgttgaataaatggtaattgtggatcagtgacttgcgatggataccgccgcttaaccgtcaccgtcatccccggtaacaacgccgcttcgatgccggctaacaattgttcttcagtcaccgaaatcggataacgacacgttaaatgacaactcaactgttgtgcctcaattgacaacccataaaaggctagctgcaaagcacccgaggccgcatcttcaaaattaattcccaagttttccccagttgattgattaccaattttagcattgagccactgatagaattggccggtctggcccctcaattggctggcatctgccactaatttcggtagcacattatccgccatttcaggtgtgttacttggcgcctttttgccttgataagttttgaccgtcccatccgctaaaagtaggcgagcgtgatccggtaaataacttttggcaaactgcccgtcaatcgccgtgatttggggctcagagccatctgtaatcggcaacgataactgaacgtctaacaaaccacgttccccgtaaacggccggaaacttgcaatctggcgtaaaaccggcgtacggcgctgcttcttgttgtagatacaccggaatatcttggctccctgattcttcatccgtgccaaaaataatccgaacccggtgcttaaatgttattttttgcgttttaatcagataaagtgcaaacaatgtggataagagcggccctttattatccaaaacaccacgtccatacaagaagttatccacttgggtaagatcaaacggtggataatgccaatcattctcaacgtcgaccacatccaaatggcccaagataccaaaatacgttggtgcttggctttcatccggcccatattcagcccagccaacacaatcaccgacttgccctgttctgaagcccattcgcgtcgcaattgacaacaccgtttccaatgctcgtttaggcccaatcccaaatggtgcttgatacgttttaacgccacgaacactcggtacccgcaaaacagccttcaaatcggccaaaaattctgcttcatattgttcaaataaagctttaaaatccgctcgaatcgctttcacttaatacgtcttttctaaagcttgacgcgtcgcttctttaaacagtgcaacgtcagccttcgatagtgactgacaaaacgaggtcaataactgaatcgtttgtttgtaatcatcttgatgaaccatcaaccgtggtgaatgcatatagcgggttggcatcgaaatcgtcattgtcacgacaccatccatcgccttatgaatattacaagcatcagtcccaccaacggtcataaagtcataccgcacatctaattttaaatcggcaacaagacgttccattcggtacaacaaccctttgttagccatcgttaaagaatctagtaccgctaagacaaccccaccacctaatcgattactgctttcattatcgagtggcgtgtccttagctgttgtgacatcgagtgcaattgctaaatctggttgaatctgatgaaccgctgtccgtgcaccacgaatccctacttcttcttgtgtcgaacctgtgaaaaagagcgttgcttcatgcggcttttgcgctgtccgtttcatcacttctaattccgcacccaaactgaaacggtcatcccacgctttcccagctaagaagttaggatcattcatttgcctaaacggaatatacggtgtaatcatatctccaatacgaattcctaacgcttcgattgcctgacgatcagcgacccccatatccaaaaacatcgtcattggcgtcatcaccttattcttaacctcatcaggtaaaccatgtggcgcccgactgcccacaataccaatatatttttgaccagttgctgttgtgacagtcatttcttgagcaggcatcacgtgtccccaccaaccgccaactggtaataacttaagataaccctctggtgtaatttgacgaaccacaaaacccacttcgtccatatgtgctgacaacatgactttagggccttcatttaccgtaccattttgctttagaataattgaccctaagttatcataactaatttcatctacatatggttgggcgtagtcatgcactagccgactcacttcacgttcacgaccgccaatgccgtcggcttcactgagccggcgtaataaatctatatcgattgtctcttctaccatttatcgattttctgctttaaacgcttgaagactatcattatcgatttgcttaataaattgaatcaatcccgccttagcagcttgataatcagcagcagcaattaccgagcgtggcgtattcatatttctaaccggaatattcacgaaaagcgttggacaacctgtccgtaacttattcacccaacctgcttcagaatcggccaatgaatagtaatattgataaggaatttgatcttgttcacaagtttcacggaaagtttggagtaataaccgattaggtaaaactgttttgtcatagtagttcaataaaacaccatcccctaaaacgcctatccggtcatcagaatccgtttgataatcaaaagcggcatccgtatctaacatgattgctaaatcaggcgctactttattcgtcgccgtctgaattcctcgtaaacccacttgttcctgaactgtgcatcccacatataaatcaaatggtagttcaacattttgcaaggcttgtaataattcaattcctagaataggtgcatagcgaccattccaattgcgactcatcaaaacgccactttcagtttgaacaaatgatgttgcaaaactgagcgtatcacctaactgcacaccagccttttcaactgctgctttacttaaaaagccaaggtcgacttgcactttattcgttttatcaacaacttgattattttccgtttgtgctaaaatagtgccttgataatttttcccagcaaaatcgccttggacactggcgcctaacaagctattagttgacatgtcgccgagtaataaagcttgcaataagccattatctaacactttagtcacgattagaccaacctcgtccatatgccccgaaaccattacgtgtggtgcatttggtatttgactctttttcactgcataaatcgatcctaagttatcgtaaatcacttcatctgctagttgctcataatcttgttttaaacgcgccgccactaaccgttcattgctagcaaccccgttaatgtcagttagtgactgcatcagattgattgtttcttgatttagcatttaatagattttatcgctcggaaactcagaaatattaccatgattagcttttatccggcagagtgccaagatatccttcaaggcatcactcaagccagtaccaccttttttaggcatcttaacgatatcaacacgttgtcgatattgattgattactgactggcattctttagacattgcagccacaactggaatatcagttttttcggtcactaaggccccagtttgggcacacatttcagcgtattgttcataatgaaaagctggcccacaaataacaacatctggatgcaactttttaatcatcgctgccaacttcaagctgacctcatctttatgatccatgaaattttgatcaccacaatataaggtcaccgcgattttttcgtccttttctaaatacttttcaaacatatcggcagaacccatcgccatttttttaccacccaagggtaaatcgccacgttcggtaccacctaaacctgcttgaatttgatctaataaaattaaaatttccatttacaaattcaagtctgcttccgttaaatcatcaaatgaaatatcttctgctttagccatctctgcgtcttgttcttctttgatgtattgtttatccaatgtcttaataaatgggtagtaaattaaacaacctaatgctaataatgcgaattgatagagtgaagccacaatgctcccagttgaaaggtagccggaaaaaccgattggtgttgtccatggtaaggccaccccattggtatatggaattaatccccatttcgttaccatcgttgatagcaagaggttgataagtggtactaagttaaatggaatgatgagaatcggattcaacacaattggcaacccaaagatgattggttcgttaatgccgaaaatccctggtaaaatagccaattttccaagttgtttaattcgttgtgagcgacagaataagagcatcacgattaatagtgataaggtactcccaccaccaccaaagttagtgaaaaagtttgagaatgggtcagtaaaaatgttaggcaatgccttatgtgcttggaaagcatccaagttttccattgttaacactttagaaattggtgcaaaaacagaattagcaactgctggtccattaatgccaaagaaccagaagattgtgcaggcaaatccgtagataatctgggcagttaaagtattgccggccccttttaatggcacttgtaagatttcaaagatgaaattatacagtgtttcgtatggtgttaacccaaaaataatgcgaattgcgaaaaagactaacatgacaactgcacttggaatcaatgcttcaaatgattgcgaaactgcgggtggcacgccatctggcattttaattgtccaccctttttcagtcacataacaataaatgggtactgcaacaagtgcaacaactagtcccaagaaaataccatttgtgccaaggtagttcatatctaaagccccatcaacgggttcctttagattttcaacaaccattttagttggtgttaggattaaaaaggctaccaaagcaactgcggctgcttggattgcatccgtatttttttgtttgccgtaagcgtaagccgtactaaaacaggtgaagaagccaactgtattaaagacagcacgcgaaacgttagtgaaccaactttcccaaccagtccctaagaattgaccccagaattcagaccaatgtggaattggaaaattagcaattaataggaaaattgaagcgacaataattaaaggtgttgtgattaaaaagccatcccgaatagcgattaaaactttgttgctccccagttttatcgctaacggcatcaagaatttttctaatttatcaaacatttaatgtttacgactcaaaatattgtggaacgtatacttgtcagcccgataatgggaattatcgtaaaagattgggtagccatccattgaataggcgaccgtgtgtgccaaaaaggcgggctgtcctggtgttgtttctagtaattcacttaaccccggttctaagataacggcttctaattcttgttgcgcgtaaccgattggcatctcttgttcaatcaaacggtagagggagccttgcgcttcgtgggccgtcaagttggggagtattctttgtttaaggtaaatctgttcgtgcgtcattggctcgttatcagccatccggatgcgttcaatctgccaaaccggttcttgctcattgagttgtaatttagacgcaacgtagtctggataaacaattgcgcggcgcagatctaacacccgagtgctcgcatccaagtgtaattccttggcggcttcggtaaaaccaactaaaccgctggccccactagaaattttgccttcggtcgctaaaacataggtgccccgatttcgatcacggaccacaacctgttgtttttcgagtaagtcaattgccttgcggattgttaaccgcgtcgtcgcaaactgcgcagctaagtccgtttctgacggtaatttttgatggacgccatagattcccgctcgaacatcttcatttaacgcttctgcaatttcgacatatagatacttcgccatctaatcaattggggccttaattcgtttttcgtaagctattaaccaatcctctgaaattggttcgataatagtggtctgatccggccctggattagccatataaatctgcggtgtctgttcatcattcccggctgcaaaagtgaattcaacattagtggccacgccccattcaccttgattattcaatgcgatcagtgagaattcacccaccttgccgtagcgtttcttaagtttttcaacaaaaggataaacggcttgatcacaagcagcttgcggcgataaccccgaacccatcaagcggacaatttcgtaagaaagacagcccttcatcaaatcttcgcctaaacccgttgcggtggcgccaccgatgtcactatccacataaaagccactgccggataacgctgaatcgcctgtgcgtcctggttttttcatgaacaaaccagaagttgacgtaccggccgccatgccagcatcttgatccaaactcaccatgccaaccgtatcatgaccgtcatacggactaagatttttttcgttaatttcctgaacgcgtttggcccacaacttatgcgcgcgcgctgttaacatgttgcgtgcttcaaaaccgttgaacatcgcatattgtgatgcgccagcacctaccagaaaactattaaaatgatcgttactcaattggcgtgcaaccgagatgggatttttaacatcgctaatccccgcaaccgccccaattgcaaacgtattgccatccataaaggccgcatccatttcaactaaaccttgtgcattcggtaaaccaccgtagccaactgatttaaaaaatggataatcttcgacttctttgatagcgatttcaattgcatccgtacttttgccgcccgcttcgagcgtcgtcatcgctttggataatccttcataagccattcgccatgtcccaatcattgcatacgtcatttatttcgtttttaaatcctcaattgagttcacgttagtcatgtacttcggcacagctaagccaactttggcaccttctaagttagggcctaagtcttcaaacttaccttggtaatccttgtagtacaaaccagatgtctttggtaaccaagcagcaacctgtgcatcggccgctttagttgcgactgatgcccacattggttggatttccattgcctgaattgttggttcataaccttgttgacgaagtacttccgcaacaacgttggttgaagcaatttcagaatcccaagcgacataagttaacttaattttcgtaccatgaacttttttaacacccttggtccatttagcaacttgtttgggattagctttaatccaatctttagccgccttttctggatcgacgccatcattaacttgtaacatcacttttgacatttccgctggtgtccagtggaaccggtcaaggatggtataagcttctggcatatcttttttaaggccttttcgaacaatcgtatcgatatgttcagcctggccaaagacatttttcggatccttcaaaaacttgattggatatttagtaaacatccaatgtggttgccaaccagtaatcacgattggccgcttatcagcaattgctttatccaaagtactggtcatcgcagcggttgaactggtttgtaactgccagttttgaccttccaaatgatacgttgataaagccttttgcgttgaagccataataccagctccggcatcaatcccagtaatcgtgtagttgatttgtgggcctaacttttgcttagcatcataaggcttagtttgtgagctacaggcactaagcaacgttactaatccaattaaggtgaaaaaagctattaatttattcttcttaatcacttaatgttgtcgttgtctgtttagtgcttgtgtcaaacgatcaatgataatagctaagataacgattgccaagccggctgcaaaaccgcccccagcatcgttccgacctacggcgaagtaaacccgggttccaagacccattgcaccgatcattgaagcaataacgaccattgataaagctaacatcatactttggttaaccccggccattaaggttgatttggcgagtggtaattgcactttaatcaacttctgccattctgttgaaccgtaagaatctgcggcttcaattaattcggttggcacttggcgaatccctaggttagtcattcgaaccgttggtggcatggcaaaaatcactgacgcgaaaacgccgggcaccatcccaatgccgaaaaaggcaaccgctggaatcaagtaaacaaaggctggcatggtctgcataaaatcaagaatcggtttaaatattgcctgggcaatatcacttttagccatccaaatcccaagtggtacaccaatcactaatgagattaaactagacgtcaacacaagggttaacgtctgcgtcatatcccgccagaaatctaagttccagattaaaagaagaccggccacttcaaagatgattaagccccacttcttcgtatcgcgattggcgaagtaagtgacccccgcgataatcacgataaataaccagattggaattaaatcaaagacccattggaagccattgataattccaccgataaagtttgttaaaccattaaagaagcctgtaaattgtgttagccaatcgacaaaactgtccatccaactagcaagtggtaatttaggaattgtcattaaattaagcaattaagcaaaatggttcacctcgtttcctgcaagtgcgcctaagacggcaccgcgaatgatgatcccacgtaattgttttttctcatttaggacggcaaatggaatcccggtttgtgaaatatcgtctagaatatccgcaatcggtgtttcttcagtggttgtcggtacgtttgcattaacaacggattgaagatcccgactttctttacgaactaattctaaaacatcccgcgcatcgataatcccgaccaattcacgcttgttattcacaacataaacggttgaaacttcattttcacgcatacgtttcaaggccaaacgtgggccatctttttcgatattgaccgttgttgggcgaatcataacgttgccggccgtataaaccttactacgatcgacattttcgataaatttctcaacatattcatcagctggacgcgttaaaatatcttccggcgtcccagtttgaacaatttcgccatccttcataatcatgatgtgatcgccgattttgagggcttcgtttaaatcatgactaataaagataattgttttatgcattgtttcttgtaaatcaagtaattgatcttgcatatctgaacggttcaatggatctaacgctgagaaagcttcatccattaataggatttctgggtcattcgctaaagcacgtgctaagccaacccgttgctgcatcccaccagataattgcgttggatattgttcaccataaccatttaacccaacgagatctaacgcttcattagctttttgatcgcgcgtttgtttatcaatcccttgaatttccaatccataagaagtgttgtctaggattgtgcggtttgggaaaagtccgaaattctgaaagaccatgctcattttcttgcgccggacttcaagtaattctttcttatcaatctgcattaaatcctcgttatctatcaacacactaccttcagttggttcgatcaatcggttaatcatccgcaccaatgttgatttaccactaccagatagtcccataataacgaatatttcgccagattcgacttcaaagttagcccggtcgacaccgattgtcgcacctgtttcctttagaatctcagctttgctcttcccttgtttcaatagttctttggcccgcggcacccgcttaccaaatatcttcgttaaatctttgacttgtaatttgacagtcatttaagcaactttcttttgataacgatgataaagtgcgatcgccataattgcaaagacgattggcccgatgaccatccagaaagcatccatatagctaccttctagcattggttgcacaatcgtgaaggcaatcccgaagactaagactaaatcgacaacaattgtcacagcctgcactgatgctttagtcttgaagaattcgtaagggcgctctaaatctttgcgcgccttaaagtaagggaaggcagtcactaagaagagataaggtaatgatgttgaaacgttcgacatcaaggttaatacattgtagaattcgctggcagctttaccaccaaatgagataacagcaattaataaacaaaccaaaacggcttgtgcccacattgccttttcaggcatcccgtgtttattgacttcagcaaagccttttggccataatgctttgggtgttcccagtacgaatgattttaatggtgaataaatgaggacggcaaatgccccaaggtaactgataaacatgattaatccggtgattcgagcaaataacgtaccgataccaacagcggctgtcgttgacataccaaacgcatgtccaaattgataacctaagttttgcatcaagacgtacgtgatattccccatgttggctttatcgccacctaaaacttggtgccagttcgttgaaatgccccacatgaagattgcaatggcgtagattaaggtaatgaaggctgtcgcaatcattaaacccttagggaaagtcttttctggatgatccatactatccgtcacgccacccattgtttccatccccgcataagcgaagattgaaaagacaacaaatgacaacatcccgattggtgattgataagaagccattggactcttaacgaaagttgtcacaccatggattggttcggcaagcttaaagcctgtcttgaaccaaattgcaagactgatcactaagaaagctgcgaataaaaaggccacagccatcccactgaaagaagcaaacttctgaatcttatcaatcccacggcttgataggaaggttaacgctaaaatccaaagcacgcctaaaacaccgacgacttgagtcccgtttaacccgataaaatgccaagttgttgtttggtctgatccttgtaagaaagttgaaaatggaatccacactttcgcagcggtcgataccatccaaacaatccatgaggctaaccagatgaacgttccgatgaaggcggccttcttaccaattgacgcttcaagccatgaataaaggcccccacgcgcttctttcaatgatgaaccgtattcggcgaacatcaatgaggttggtaaaaagaaaaagatagctgctaggatataccagataatactggcatagcccattaaataaaaggcaatggtggtattcgcaaagccaaaaattgatccaaagatcatcaagattaagccattgacattaatcttctttgatttctccatttaaatgctgaccattctaatcgtcataatattcttattcatcgaaatgtcttctacaatttctgagtattgcatctctcgtggaatttcgattcgataaacgttggtgtaaatcgtatcccgttcattttgagtcaccgagaaattgacatcccgaatctgaatatggtgttcctcaaaataagtttggataaattccttggtctctagtttgtgcttgtatttaatttcaattttcttcaacgtattgatatgaataattttctttaaaaagacaatcacaaaaatgacgaaaacggcactaataacggcaatttggtaatagcccatcccaattgctaagccaatgcccgcggttgcccatagtgaggctgccgttgtcagtccctgaatcttatgacgagttaccacaattgtaccggcacccaaaaacccaatcccactgaccacttgcgcaatcaaacgtgcctgatcagaacgaatcgtggtggcaatcgccaaatggtgtagcgcaaattgcacattttgagcagcaatttcctgttggatcatcgcaatgacacaggcccccaagcagaccagaatatgcgtccgaatcccagccggacgatttttatactcccgatcggagccaataatcccagcgattacggtcgctagggtcaaccgaatcataatatggactgttgttacttcaaacaattaggctgctaggcccactgtttgtaagattaaatagatattcaataatgttaagacaattgttacgaaccaagccgtatatttcacccaagggcggttaacgaatggtcccatgattttttcatcactagtaaacaatgtcaatggaatcattgaaactggcaatgcgatactcaagaagacttgtgagtaaatcaaaaggttttcaacttgggcttcattcccatggtaataaaccgtgaagatgataactggtaagattgataacccacgtgtaatgacccgacgtgcccacaatggaatcttcatacggacgaaaccttccatgacaatttgtcctgaaagcgtccctgtaatcgttgagttttgacctgatgccaataaggcaacagcaaaaagtaaactcaacattgggctagcaatactcccaacaatttctttgttttgtaaagcgttaaataaatcaacaaaacgacctaaatcactgttagtaccatagaacattgctgcaccaaggattaatagtaaacagttaacgacaaaagcgattgttaattggatgtttgaatcgattactgtaaacttgattgctttacgtttttcagcaacatcatcacgatcgtattgacgtgcttgcgcaattgaagaatgtaagtacaagttatgtggcataacagttgcaccaacaatccctaatgccaagaacaacatcttcttgtcagtcataattcttgggcttggtacaaatccacgcacaacatcacccatgttaggttgtgccaagattacttcgtataagaagacgaataagataacagccactaaggttgctacaatcgcttcaattttccggaagccaagtttcatcaataataataggagcaagacatcgaatgcggtgattaagacaccccataataatggaatattaaagattaattctaacgcaatggcggaaccaataatttctgcaatatcagtcgccataatggctaattctgtgacaatccacaggaaaatccccatctttttaccggttttggcacgcgtcatctgcgctaaatccatcccggtaacaattcctaaacgtgccgccattgcttgtaatagcatggcaattaagttcgatactaaaataacactgatcaaggtgtaagcaaattgtgccccaccggcaattgatgtaatccagttacctggatccatgtaaccaaccgcaactaacgcaccgggtcccatgaaagccatcaaggttttccagaaaccagcgttcttagggatcgcaacggtgttgttaatttcttctagactactaccatcagcataatgaataaatttctcatgcttttgtgaatcttctcgctgtttcttatccatctaaccggcaactctcgttaacgaaattcggcatatttgctgtgaattcacgataatttgttgcattaattcatggacgatgaaacgatcattcggcatataattcaaaattaagacgtgcacagtctcttcgcacttctccaagaccttccctaaataaggttccgtcatcatttcattggcttggcatcgtaccaagtcacctacattaatcgtcatttaacgattaatcttcttgtaattttcatcgaagtaacgaccttcttgaatatcttcaatcatcccttcatatggtgcttggctaataacatcttcattgttttgaccagcatcacccatgtaagtaattgtagcgaattcaggtaccaataacttaggatatgtttcgtatttttcacgtgattcttccatcaatgcgatatggtcgttttgataagtgaccgtaatttctggatgttcttcaacccatttagggaagaagattgtaccgtgtaacttgttttcgttaggcatgaagtccaaagcaacatctgtcccagttggttcagtccaagtaatcttgaagacaccgtccgttagtttaacaatattggcttcttgatcgcgaacccaacgccctgcaaccatcccaccatggatacggtagtcaacggtatggtcgtttttagcataccattcgtacttccaaccattatcatacgtgtaaataaagtgtgtgcctaaaaagtcttctaattctttaaattgttttgtcatttattttgtaaaatcaatcaccattcggcctgaaatcttaccttcagccatttcagtcataatatcattgatatctgccaagggtctggtttgaacaattggtgtcactgcgccttctgcagcaaactcaaaagcttccgctaaatcagcccgtgtcccaacaagtgagccgatgacttcaatcccatctaatactaatcttggaattgaaagatccatcgtttcaacaggcaatccaacagccaccactttgcccgttgcacgcacagcatctacagcttggttgaaagcgaccttagaaacagccgtaatcacagttgcgtgggcgccatcgccagttacttctttaacccgggctaccacatcttcttgcttgccattaatgataacatcagcacctaattccttagcaattgctaacttgtcatcattaatatccactgcaatcactttagcattgaagacattcttggcatattgaagcgctaagttgcctaagccccccatcccaaaaataaccaaccattgacctggtttgatgtctgaaaccttaattgctttgtaagttgtgacaccagcacaagtaatactgctggccgcaattggatccaaatcttcagggactttcactgcgtaatcagcggtgacgatacattcttcagccatcccaccatcaaccgtatagcctgcattttgcgcttggcgacagaatgtttcttgaccattcacacaataatcacaatgccctaagacacggccaggtacttcgccaaaatcaccatttttaacatgcaagtcggtgtgacaaacaccgcagtattccatcttaacgagcgcttcattggctttaattggacgtaacttcttatcaataatatcaactgtatgttctttgtttgcgaccgctgcttccatttatttagttgctgccaattgtttcttgatagctgacttcaaaataaacggtgctagaatcgttgtcaaaataatgacgaagataatcgctgaataatacatttcactcaataacttcgctgtataaccgatttgcgcaataatcaacgccatctctccccgcgaaatcatcgctgccccaattgtgtaggcacccgcttgtgggacacccatcattttggcaccccagccactgcctaataattttgccaacacggctaaaacggttagtacaataatgaagactaaatgccgatttaaatcggcaaacgtcatcgataacccaatgctaacgaaaaagacaggaatgaagactgtatagcccagtggttcaatatgacggctaatttcagattgatatggtgtttgcgaaatcgcaattcctgcaaaaaaggcgcctacaactgtactcaaatcaacggcttctgctagccaaacaaaaacaaaacaaatcactaacgacataatcgcatttgcataaggcaccaataaccgctgactcaagcgcatcacacccggcactaaccacttaacactgaagtaaaccactacgaaaaaggcaatttgtaaggcaaaggttagcccaagtcccatctgattaggcgcagcggtggctaattgcgcaccgaagagacttgttaagacgcttagaatgattaccgccaataaatcatcaacgactgcagcccctaaaataatcgtaccttcgcgactctcaaggacttttaattctcgcaaaacttcgaccgaaatcgatactgaagtcgcagcgaaaataacaccaataaatagactctccaattgattgatgccaaacgctaaactcatcgcgtaaattgatcccacaggcacaatcacacccaaaattgcgacaactacactgggtttgaagtacttcttcaaaagcgttaagttactctcgagaccggctgtaaacatcaataagacgacaccaatctctgaaaaggtatgaataaagctattctcatgtaatacacctaacaatgccggacccagaataatcccgacgagcagctggccaatcaccgccggcataccgattcgtttactgagatgaccggctaataaagtactgattaagataattgctaatgttgacatatgacaacccagattaacccttacaatcaatcgattgaggatttacagaaagattacccgggaaatgattttgaacaaggcctttcccaagtcgaggcacaaaaacgtttagccacaaacggccctaacaaactagaaagtaaaaaaacacctaaatggcaactcttcattcgccaatttaataacctgattatctacatcttaattgcagctgcgctactcacaactctgatgggtcactattctgatgccatcattattggtttagtggtcatcatcaatgcgattatcggttactaccaagaagccaacgcctcagatgcacttgaacgcattaaggatttattggcgaccgaagcaaccgtttatcgcgatggccaacgaatcgatattcccaccgaagatttagtggttggtgatgtcgtcttcttagaagccggcgatagcatccctgccgatttaagaattgtcgataccgataacttgcgcctcgaagaatcagcactgaccggtgaggctgattcggtcgataaacaagcagcagcgctcacaccaacaactgtcccattagcggaccaaattaacatggcgtttgcctcaacctccgttacaaacgggagtggcttgggcgtggttgtcgcgaccgctgaacaaactgaaattggtcaaatttcaaaagcagttacgcatacacaaagtcgccccacaccgctgacccgcgagattaataagttaggggccggtgtttcttacgtgattattgccgctgccatcttgttattcatcttaggtttcatcagcggcctctactcattaccggtacttgccatcgctatcgtcacgatggttgttggttcaattccggaaggactccctgcaacaacctctgttattttagctatgggtgttagtgacatggccaaaaataaacacgcgatcgttaaaaccttacccgctgttgaaacattaggttccgttgatgtgattgcaactgataaaactgggactttaacgaaaaatgaaatgacggttaaagatatcattaccgccgatcaaatctaccatgtttctggtaacggttatgcacctgaggggcaaattcaacaagctgatcaaccagctgttatcgatgacactctcgccctattcttagaagccggttttgaagccaatgacaccacccttttcaaatcagatgagggttgggcaattaacggtgaaccaaccgatggtgcctttttaacggtctaccacaaaggtttctcgattgatcaagtaccgcaaaataccgaaattgacatgttgccgtttgattctgattaccgctatatcgccaaattagttcaaacaacaactggtcaacgccgcctctacattaagggctcaccagataaattattcccgatggcgcaacaaaaagacgctgccttcccactagatacttggaatcaacacgttcaacgactctccgaacaaggtaaacgggtcgtggctgtcggttacctcgacgtaccagcatcaacaacgacgattacgcatgaaggtcttaacaaagggattaccttgctcggcttagccggcattatcgatccgcctcgtgacgaagtgattcaagcactggctgaaatgaatgcggccggtgtcgatgtcaaaatgattacgggtgatcatcccttgaccgccaaagcaattggtgaaaagttaggtttggccccagtcatcaaaaccattaccggccctgaatgggatcaattatcccctgaggataaagaaattgccgcggttgaacatcaggttttcgctcgaaccactcctagcaacaaactcgaaatcgtcgaagcgctccaaaaacaacacaaagtgacggcaatgaccggtgacggtgtcaatgacgcgcctgctttaaaacgtgctgatattggggttgcaatggggattaaagggaccgatgttgctaaggattctgcggatatgattttaaccaacgataactttgccaccatgtccgtcgcaattcaagaaggacggcgtatttacgataatatcaaaaagagtattctcttcttattaccaacgtcatttgctgaaggtttaattatcgccttcacgattttaatgcaacaatcaatgccgctccaagctgctcagttactctggattaacatggtttcggcaattacgattcaatttgccttcatcttcgaacctgctgaagatggcattatggcgcgggccccacgcaaaacaggtcaaaccttaatgaacaaacacgacatcttccagatggcctatgtgtcggtcttaatggcgttgattgccttgtgggcctatgactggttactcggccgaggtgttgatcaagtgactgcaagtacgatgatggtcaatatcatcgtcatcagcaaaatcttctacctcttcaacatccgaacaacaaaattagccttttcaaaagctttcttctcaaatccaaaagccttcgggattatcgctggcatgattgttctccaattgattttgacttacgtaccgtttatgcaaaaactattctatacagaaccactaacactattagaatgggcggtatcaattggcgctggtttcttaatcctgattattacggaatgcgataagattatcagacttaaactaaaacgataactataatcgactaatcacttcgtcgacattcttgatttcaactgacattgttccatccggatgattgataaattcaaataggtccggattttgatagacgtcaattggaacgattaattcaattccatttgataattttaatttttgtttaccgtatttcttctcggcaatttcacgcacggcaggtgaaatgggcgcatccgctggcgccttttcaaccatcgctgctttaaattccgtttgtgctgagacattatccttgaagaccttggccgcaacatcctgcgtattgatttcaccctttgcctcaatcgtttcgtaaattgcctctttcacattggcgacaatatcatgcttagcgacttcaaatttcgcaccaattttttcggcggctttcttcacaacccgcacattttcttccaaggatggttgcggttcactctcaatgacttcagttgacaggtatggccgtttatctccagagaaggtatattgtttttcaattagttcaaaccctaaggtctgcagattgatggcaaacccttcgtctgctttttgcgtcttattagataaaattgattggtgaataattaactgattggttagcggtccctcttcagcattcacatagtgggtataagcttcatgataattaaccttcaaaaaagcgacataagcctgcgtatcctgttcataaagggcgataaaaacatcggcactgggcgcgtcatcactcttttggtaagcttgataccacttatccacaagttgttgactgacacctgtaaaatctgaggcgatattcaatagttggttagcaacctcagaaccctgacgaatcacgcctgttttactctgcgctgacgataattttttaattttattggttaaataatcccgcgtattgccgttggttaaatccagcggttgttgggaataaattggtgcgcctaattcgcgatcaaccacttgtaatatagcctgttttaaataaatatccacttatttttgaaaggctgctaaacttaacgccccaattgcttggcgttcagctgccggattttggacttgatttgttaagacaacaatcgcaaatggatcattatctttaaagacgatccccacatcattttcaacatcggctaactcgccggtcttgttagcaacgaccgtattagctggcaattgacttgggattttagtccgcgtttgttggcccttcataatcgtcaacatcttactgtaaggtgcctgatcccgattttgatagagttggttcaagaattgtaagacgtctttcacggacgtatagttatccaacccttgattacgggctgcatcatctaacattttccgttctaacttagtctgtgtataaccttgttgttggatatactgattgatttcggtcattcccgcaaaatcaattaacaagttggtcgcgttattatcactctgttgaatcatcaattggatccattcatcgactgaatggttatcaatatagtgaccgccagaaatcttaccttgtttaacctggtcatagagataatccatgatgaataacttaatcacactagctgaaataaaaggttggtcctgattactaccgactgagcgcttactgttgtaatagtagatcccataaccgaccttttgcgcattagcagttagattttgtgtatcaaaggtcaacgctttttcagttggttgcttcttaggtttttcagtcgctttggctgtttgtttaaccgccttttgtgaccggttagcggcggcctttttggcttttgactgggcctttttgcgagcaaccaatgattgttgtttagcgcgactttgagcagcttgatcttgacgatttttagcgaccgcgataccaataccagccgcaataatcacaataatgccgatcacaactactaatatgttccgacccaagcgttgattcttttgcctactaaacttttctctacgcggttccattcagtttccgattatgtcgctgaatccatttctcaatgttgtattctctgtttccttaaacgcaatcgaacttgatgtgctcccttgaccttcttgtgcaatcaagaccactggtcggccatcatgaatggtaaatagataaaaatgatcttcttcaccaccactgttggcatccgagtaagctgcgacaactttataatctgccttggccgaaacaccatcttcagaccatttaacagttactgggctcccaccaacttcggtttgaatggcaccagataataagtcgccaggtaaatcaacaccatacagcgagacattatgatggtcgctatattcttggtagtcctgatccatttcagtgccccagtcagccataaagctctgcagactatccttcttagactcggtccataacggatttgcaacggattccgaactacttgatgatacttctgaatcactgatactttcactgtcacttgcttgtgtgctttgttgttttgaagaagcacttgttgccattttagtatttgctgccggcttttgtaaataaaagcctgcccccacagcaattgctaacacaactaggcccccaatgaggattggtacccactttttagattttgattgttgtttaactgcctgacgactaaccaccggttcatggggcgtactagctgagttgttaggtgtcaccgtatcttccttaggttgttgcgttgctggttgttctgtagcgtcttctagtggcttgccacaattaatacagaatcgtgaatctgcttcatttttagtcccacaatattggcaaaacatttatacagatttaaaataacgggcaccttcaatggtatgaaaataaatcaccgtttcaaccatttcgttattcacactacttaaaaatggccactcaccttgcagcacacgtaaagccgtttgtggtcgcgataattctcgttggaagttctcctgaaccgcgactggcgtatctttgaaaattttggcatcggataaataacgcgcataagcgctaaaaaggcgcttggcttctggtgttttaatggcaccgtaaacttcccgtagcgcttggagtccgtaagtcaccaaactcgccaaaataatcgtgccattcctgttctcaactcgtttgaggtaatgaattagattgccccagaattgactataagcctgcatctcatcatctttgagatactctcgaatatccgccacaaacggataggtccagttacgggcgttcaaataattggccgttccaatatagaacgtatacggaaagccaaaataaatccgcgttaaatccttgataaaccattcattattaatttcggcatagtgtaagcccgttttaacctgcaggagttgctcaattttcttatcttgcgtattttgcttagttaattcaaacaatacctgccaagtcgcgtcatcacataaatccggtcgataatgcttaatttgcttcaattggaccggtgccgcattcaaggtgtaacccgcattaaacggttgatctaataactgcaaggtttggacaaaatgaccgcccagtgaatggccgaggccataaatccgtgtcgttgcttcaatctttttaacatgtcggaccacgtaccgggtgaaacgccgtgctagttgtagttgctcgtcgttatcggcgtgaccaatcaacatcgcgtcgatattatatttccagtcctgataactctcgcggacataattatccaaacgctgacgaaacgatttgattcgcggatcatccatcgtcccctctgttcctttatacgaaataaaggtcatactttgttgtttgaaggtgaaataatacgcaacggctgagaatcctgttttctcggcattcggtaaaatagttcgcgcatcgtatatcaacacattatccacagattcttgggtgtagcgataaacaagtaagcgaatatggcgctgtaactcaaccggcgtgaacataatatccatatagttgagcatcatcatcgccatcttgaaatcccggcttaaaaaaggcaccgccaccggcgcaacatttggccggtagtgcgcaataaacgcggttttttcggtttcgtataaataagccagtacttggtcacataagacgatactggtttcgattttttcaccttgtaagttcaggattaactgacgcaggcgattaattttgcgctgccgattgtactctggtgccgcaaccaatgctgcttggctttgctgattcaattcgttcaactgaccgattttctggcgtaaataaatatcgccactcgtcaacttcagcaattgcttcaataactttgttttttgatttcgcagctgttggtacctaaattcaaaacgattattttgccgcaacagttcttgtgattgctcgcgatccaaggtaagtggcaccttcaaatgcgctttgaacaatagcttccctaaatcatctaaaacagtctctaggcgggttaaataaattatcatttgttcagtttccatttaaaacgaaatttcaaattccaaatgatgatcctgcgtcgcatctatttgataggccgcttctacgtcgctaccccaactatcgataccgcccacgccacgaacggcccctaagagatttaagactgttcggtgtggtgcgggtagttctgaatgatgggtcgcattttccaattcttcagcggtatatggcaaacatgaaaaggcaaatggttgatcgaccatcttaaacttcaagccggtttcgactggttcgcgcaaacgattatccagaaccgcttgccgataaatcgttacccaatcagttgccatgtgcacaccacaatcttgtggcaccagataaggcgtcacaggtagcccggtgacttcgtactcaccagccattccaccagccattcgatctggataagtttcccctgacaacccttgataaataaagcgcgtcgctggggttggcatgacaaagcgtaaaccaaagactggtaatgatggtaatccagcttgaccatgataagtcaccgctacacggattttaccactggcttgaatcgtataactgacttctaccgtcgtctgcggcgtcgtaattgtttgataggtatacgtaaccgtcacttcttgggccgtttcctgaccactatagcggttgttctcgggcgcaattggcagcggaatcgtttgcccgtcaatcgccactgtaatcgactgacaagcaatgaactgatcagcagctagccacattcccgatttcaatgggaattggttgccgcgatcattatcggtagttgcccgccaaaaagtcggttttggtgagcgatatagccattctttaccttgaatccgcaatgattctggcccacccgtttggtacgaaaagaggtagtgaaagtcagggcctttaagtcctaaagtcacttatttgtgttcgccataatagtatctaacctcctgcattgctggtttttcatcgcgggtagcaaagactaacccatcccctgaaaattcatagtctgatgggcggtcatcaaaatcgccaccgtagcgtaattcacgttgaccagtcactggatctgtcaccaagagtgcttgatcaatgaaatcccagataaagccgccttggtacatgtcgtattgtgataataagtcgatatacgattgcatgccacccagcgaattccccatatcatgcatatattcgcagagaataaatggtttttgtgggtcgttatctaaataagccttaatctcagccggtgtcgcatacatccgactttcaacatccgaaatcgtcgccttatactcgggcgcccggaagaccccttcataatgcactaagcgcgttggatcttgttgcttgtaataggcattcatcttctcaagaacactaccagcataagattcattgcctaatgaccaaaagagaattgagacgtgatttttaaacgtttcaaaattggttcgtgctcgatcgagcgtcgccgcttcccattcatcatatgaacctgggacgttccaagaaggttcgaccgcccccattttttgccaagaaccatgcgattccaaattggtttcagccatcatatagatgccagcttgatcgcaaccattataaaaggataaccgatctggataatgcgatgttcggacggcattgatgtgattacgctgcatgcaggcaatatcccacgcttcatcttcggccgtaattgtccgaccagtttcaggatgccattcatgccgattgacgccgttaatgactaaccgttttccgttgagcaacatcactttatctttaatctcaattttacggaagccaaatggttgctgactaatttcaatcgtttccccagcttgatccacaacttctagctctaatgtgtataagttaggggtttggttggaccacgcttgaaccaattcgggcatcttataaaggtcgttcacctgagcgccacttgttaaatcggccgttaaaatgatttgatgttggtccctaatgcgtagatgaactcggttttcatcccctgaaaattgaagacgaagtttcacctgtcctgtttgctgtgccacatcatattcgggaatcacccataaatcttccaaatgcgtgcggggtttagccaacaacttaacatcccggaaaatcccgaagaagcggaagaaatcttgatcttcgatgaaagccgcactactgcgcttatgcacttcaaccgccaagcaattatcagtttctttaagataaggggttaagtcaaattcggacggtgtaaaactatctccagcatagccgataaattgaccatttagccaaacatacatcgcttgttcgaccccttcaaagcgaatgatgacccgttggtttctcaaggctggcgttaaatcaaaatggtgcaggtatgaaccgacgggattataatcggcttcgctaaacataccgagatgttgcttgtcatcgggtgttgagaaagcgggacgccgataataatgcccttcccacggatacattgtgttgatgtagtgcaattgctcataacccgccaattcgatatgttggggtactgtgattggttcaaaatcttgcgcatcaaatgctaattcataaaaagatttaggacgactcgccgcattaacactgtagtgaaattgccacgtgccattcaaagattgttcaaacgaactctgttgttgggccatttcggccagtgtcgcatagtaacggtgatcactgtgggcaggcaattgtcccactctgaatacggctggtgtatctaaccattgaatattaggttgcatttaattttttatcgttatcatatttactttccccagtacccttaaagcatttaatttaaagttagaatcttcttgaagagctttttcaacaacatcaatcattctctgatctaaaatatttatttttttatcctcatatgcttcattatatgttttttcaaaaatagttatataaaagcagaatatttcaaaaggaaattcatctaataaatcttttagcttttcgacattgggagccaatacattgatttctttcatttatgctaatgtaaacccctgtttcttcaaaaaggccccgacttctggacggcgtggtgcactgaaaaagtctaaattcttacttgtccagtcagcctgttgttgatttgatccccgattggcgtaataatctgcgatttgttgatcgtattgttttaaatccgcaaattgcgcccgtggatattgattctgcgctacttgattgatttgtggcagtcttggtttaacctgatttttcgtctttggaatgccgacggttaacccaaagaggggcactgtatgttctggcaacccaagtaactcagccacccgcgcgatattattccgaatcccaccgatataacaaatcccgagccctaatgattccgcagccaccgccatatcttcagcagcaatcgttgtatcaacactcgcgactagcaaggcctccatattttggatgccggccaaagattgaccctgggctttcaacatgctagcttgacgatacaaatccgcaacgaaaacgtaaaatgtaccggtctgattgacgtagctagcactattagaaatcgtcgcaatctcggtgcgcaacgctaagtccgtcacttcaatgattgaaaaagcttggacgaagttagatgacgaaccactctgggccgccgcaattaattgctgttttacctcagcgctcaagggtgtcgcttcaaaattccgaacagaaacatggtgttgcatttgtgcgattaaatcagacatttaccagtgaatttctgtaaaaatctttgggcctttacgcatctttgtccgatcattcttagcgacgtcagtttgttttgacttaccgccacccttcttttgatcgattaaggcttgcattttttctttttgcttttgatccatttatttttgaattgcgggaattaataagtcagtgactgctcggactgagaacggattttggcccgttactaattggccatcttggacagcgaatgacttatacgcccgctttttagtgaattcggcgccattttgagcggccacttcttcatttaaaaatggtacgacgttcttcttacctgccaacacttcttcggctgttgtaaaaccggtcacttttttaccggcaatcacaaactgaccttttgtatcttttaattgcaagagtcccgcaataccgtgacagactgaagacaggtagccaccttgttgataaattgcccgcgcaatcgcttggatttcggcattatctgggaagtcccacatcacaccgtggccccctgtatagtaaatcgctgcataatcagccggattaacgtcgctaggcttcaatgtggcaactaagccgcgttgaacgtaatctggttgttcataaatctccaaaatcgcttcatcggtatatttcatcccccgtggatcaagcggcacaaaaccaccttgaggactgacaaagtcatagtcgatgcccgccttttgcatttctgcgacaaattctgccgactcacccaaccataaacccgtgggatcagttgtgccttgataccgcgtgacgttggtatgcacgattaatacttttaccatttactttctttgtaacaacccaaacaacgttttgaactgatttttaaaggacagcatgtcgttaaaaatatcctcgccatcgttgagcattttaaccgtcaaccaacccagtgcttcggtgatcgacatcgcaaccgttgcgttaactgctgccccagtgactgtcccgacaactggtacaagcttcaaaatattcccgacagcactgcgacctaacccaactaaaactaattccttcgacaaacttttaccaagactcgccgaccaagattggccgaataatttatgcaagcgggccatcattgtcaattggacaggtactaataagaaagcatctgaaaatgggattggtgaacaaccaataatcgccgctgttaacgaggctgcatgaataatattatgggcttgttgccgtttttgatcgtcaacacccactaagaagtcggcaaagacgctatcaaactgcgtccggctcttggccatcgtcttctccgccaatgctttagattggttgaaggacttggcaataatcgccgctgattgtcgtggtaacttttgcaaaacttccgtaaagaatgaatcgaactctggattattatcctgattcacttgccgcttatcaaataactttttcatttacttcttatttaaatcattcaaggtttcattggctttttcaatcaacgagacaactctcaaaatactttcagtttgctcgtccgttaaaccacccattttaaaaggtaaatcatcagaaatattcaataagtagtctgctgacgtatcaagaatactacaaatactgaccagcgtttctaaggatgggtatgatagcccttgctcataggcagaaacggttcccttactgacccccagccgttgtgaaagttctagttgagtcaaccgctttgctttacggaccgccttcaacctctcaccaaaaaaattaattgtcatatgcagaagcatttaaccgtcattttgagtgtcatagccatattaacgttagccgcctgtgggcaagcacaaacaaaagccccacaaactagtcacaataagaacgctaaggttgcttcaactagtcatcaaaaatcggcctcacacagcacaacgtcgcgtgtcgccaaaaaagaaacgactagccaaagcaccaccgccaaaagtgattcaacaacatcacaaacaccggcaaagcaaactggcatgaatctcactcagatccaagcgggcgattacagtagtatcgccggtcaatggcagttaagcagtcgccaagctaaaggtcgcgagatgacaatcgataatgccaaacctttagcgattaccaacgatcaactcacatcagacagtatgacgctcagcaaagctggcttaaaagacaatacaggtttgcatccagtcaattttaaaaccgttaatggtagcctagcagtcctattagcggattcagttgccactaattggtctgtcaccttctatccaattggtaccagtaccgaatacggccttgaagccggcagtaccaccaattcgaaaaacgtaattgttatctggaccagcaacatgtcattgactgacgtctatgtgcaaagttaactaattaactttgtagtaaacagctgacgcatcaacagaagtagcactcgcttgcgtaccaaccgaaatgattttatcctggttaacatcgccgtcaattaaatcacccatcgtgcctttaggtaagaatgaaatcgttagtgctgcactcggaatcgtactccctaaagtaaagacgccatctttttcccctgattttaattgttgttcgtaggctttagtcgttgtaccacctaaatatggcacatcttgcggtctaccatcttggccatctaatcccggaatatcaattctttgtccgattacagttgcggttcccttgtggtctaagatatctgaaaattgcatcatttgatccctaatgacaatttttcgaccctcgccattttgccaagtaccatttagactcgcatagttaccggttttaacctcttcgtaattcatggcttgggcttgtttaggcaaagctttggttaccgtttctgatgacgttgatgatgctgtttcctgaacagcttcttcttgtttaacatattctttattcgctttaatcgtcgttttgatttgttgcgtcatttttttcaacccttgtgtcgtatacacggttgaccactgctgattaacgtcagccaatagctcttgtaaccggtcatttttgctcgtgacagtctcagcactaacagctttggaaagtgtattatcctttaatacttgttggttttgatttttaaagacgccttgacccatcgtaatcgctacgtgataggcctgattaaccttgctactctgattatctttttgatggtaacgatcggctgccgtcaccatttttttcaggaccgttaatttctgtgcatccccttgcgcctcattaaaagtcttaacatccttttgaatattatctaattgcgtcgtgatttgcgcttctttttgctgatcctggtaccgcgtataaccccaaacgccaccaataaccgcgatgatcaaaatcacaacgatccatactctatgcttcactcaaatccggtttaggaacaaataaggtaaggctttgaaaaggcctttaggattattcatcacgcgtatctttggcatatcggcagtagctgttttatataaccgatatggcacattctttttctcggcttctttttccgttaaaccgacgtttgataaaggtgggatgataaagacactatacggtactgcttgacgagcgaaaacccgttggttgttatcacccactaattgattgaggataatccgataatcatccaattaaagataaacaaagtcattattttttcctaattgaattaatggaattttgtggtctaaaagataattataaaaattgttgatcctcggtgatgcctcatttttaggaattgtatattccttatttaattcacttatacttgcgtccacactttgataatattcatttataccatcagtaaaaatactagtatgatctattagataatagataaaatatctagttaaccaaaatttctcactcattctattattatttctctctggataattcatatgagtttcagttaatagatgatctaatatacttaacaattcatacatcgcccatccatttttaatccatattattatggctaaacatattgaataatcatccatatcaattgaaataacattttctatgtcatctttacctaataagctactatgctcaaaaacgacgcaatataacagaatttgatatacctcctgattccaattgttatttatacacctccttaatttttctctgtacatttgacaattactatctaaataatctcccactattgataatacatcttcacgattaacgcctctttttataatctcctcagtaaatgacattaatcgattagttagtctcgagtcctttaatgaagtatccaacaacatttcatataagttaaaacgagtatacgactccttagttatgaatatttcggtcaacttttctgcacctatctctttttttctgagagcatttaacaccaccgaaaacatacatttaatagctcccttatttccttgagcttcttcccctatacaaaatttccaaaattcattaatttttttgatccaagaactagatttattctttttattcaacccatcaaagtaattaaaaatttctgttttctctctattattagtaaacggaaatggattctcagacgtttttttatcatttataataaggttattctctctgcatattttactaaaatcagtcaaaaaagattctttctgtgattctgtcgaaaatgtaaattttatatcatctacatatcttgagtacgtatatcctttttttaacatacgcttgtcaatatagcacatatacaattctgttattaagcgtgtcgctaaattccccgtgggtacaccatgagtttctccatattgacattgttgtaaaattgaatctacttcattagcaacccccccaaaccgttttgcctttgaagcttgttttccttcaattacccacggaatgctgtgcgtatataaagtatgatagaaattagatagatccaccgaaagaatatttgttcctccgtataatagtctctgttcaattttttttgtgaattcataattaaattccaattgattaaaaaatttagaagtagactgcacattatctctatacatatcaaaaaaaacagatttattatccgagatataatagcataactctaaatagctatacagatttggcattttgtaaagtcttcttgtattctgatttttaggtatattaaaaagtaccggttcggttcttatatttttatcaattttattaaagttaaaatattcacgtaagtttaccttttccaataaattggaaaactcctgtaaatttagaaatttcaaataaaaactatctggacttccgtagtattgttccaactcactattatcaattatagtagattctgtttttttcattgatacatcataatatccgtatctcactaaaaatgaaacatcaaaaattgtcgaatataacgcatctaccctatattctttcattcatagcctacctccaccagtcttatgtttcttaatacttttaattagcatttctatagaatccttcatttcgataatcgtgtagttatcatttagcggtgcgttctccggatggtcaattaaactcctaatataggtaggtaaggtctttttaccacactgccaatcttgacttgaattgtacatcttatttgcaacaaactgttcgctttcttttaaccagtcctcaaatttagtaatacttttctgcccagaaattatttgcaaataagcatataattcattgtgaaattcaatgctggccattccaaatgcaatataattaatttcaccccaggttggactgcttggtaataaatccaattctttatttgctgatattctctcatcatgtcgtgagaatatattgatttgattattctctttattaaaatgctttaacaagtacggtgaatgtgttgtcacgaaaacttgagacattttcgaaattttttttagtgattcaattaatttatcttgtgcactcggatgtaaaaatgtctctggttcgtctataaaaaataatataggcttggctccccctctatctacttgattactattcgcatatagttggattaaagccatagcgagtgctcgttgcatccccgttcccttctcgctaacttcagtttcaactccattatctaacaataatatttgaccagttttaaagaaattatccaattctggcaagccaaaattaaatttcacacctgtttccccatactgttcagtcattatattttcaatactcccttgtacatcatttagaattcgtacaagtccactatctccaaaagccgctttatgtgcttctcttaattttataaataccggtgattgctgaaaatcttgagttacagagttaattaatttacctacgattttagtttttccgaaatcttgataatcttcattctttaaatcagaatatacaaattgagcatcaaataaactagctatcgttgaatcaataccactaggattttgccactcttccttaatagggttccatactagaatattttttatttctgttaatttagatttcccccttgaatctgtccattcatgacgctcactatctcttcttaattttaaattctttgtattattttcttcaaacacataattctcatacttcttcagcgaattttcttggactagttcaagaagatcttctcccgtcatagttatttcaacataaacttcttctttctctctccctttagtaatccataaggacttagatctccctttttgcataaactcgacagctttaaatatagttgttttccctgaattattattacctacgaagaaattaatacctgaattaaaatctatcgtatgtttatttgaaaaacttctaaaattacacatacttatctttgaaatatacatttaacgttttgagaattgtgaagctttacgagctttcttaagacctggtttcttacgttccttcatacgagggtcacgtgttaacatgccagcactcttaagagctggacggaagtcagggtcaactgtcaatagggcacgtgaaataccgtgacggattgcaccagcttggcctgagaatccaccaccattaacgtttaccaagatatcatagctatctgttgtttcagtaattgttaaaggttgtttcatatctaaaatcaagttagcaaatggaacgtaatcaacaacgtctttgttgttgatagtgattttaccagtacctggtactaaacgtacacgagctactgagtttttacgacggcctgtaccgttataagttacttgagccacttaaataatgtccgtaatgtctaagacttctggattttgtgcttggtgtttgtgttcgccaccagcgtaaacgtgtaacttcaagaattggttgtgacccaatgagttcttaggtaacatccctttaactgacatttcaattaaacgttctgggttgttttcacgaatttcgccagcagtacgagttttcaaaccaccaggatgattactatggtgatgatataacttgtcggttgctttgcgacctgttaatttaattttttcagcgttgatgacgatgatgttatcacctgtatcaacgttaggtgtaaatgttggtttatttttaccgcgtaagatagaagcgactacagttgatagacgacctaatgcaatatctgttgcatcgatcacataccatttacgttctacttcgcctggtttagccatgtaagttgtacgcacctatttataataaacttcttttaaatacaaaccgcttgctggcgcggttgagcgcgcctgttgccgatccttcacttcatacaatcgtaaaaagtcatgtacgtcgcggcgaccgttaccgatttccaataaagtggccactaagatgcggatcatattatataaaaagccattgccatggaattcaaaaataagttcgttttcagcttcgttgtatacaacggttgcttcatagattgttctgaccttatccttgatgacccctccagcggccgcaaaactcgtatagtcatgcgtccccatcacgtcgggtaatgccgccttaatccgttcaacatcgattggataaggatagtgacccgtataacgccgtttaaacggattggtataatggcccagatcaacccggtacatataccgcttgccgaccgttgaaaagcgcgcatgaaaatcatcatctgccaattggctatcaaccacttccatatctaacggtaaaaggctgtttaaggcccgtagcatgcttttagcggggagctcagatggatagtcgaaatgcacaacttggcccatagcgtggacgccagagtctgttcggccggaaccgtaaacttgaatataggcgcccttactcatcttggttaaagctttttccaaggtgccttgaactgtgcgttgcttaggctgaacttgaaagccggcaaaatcagtcccatcataggcgaccgttactcgatagcgttgtgtcatttagccaatctgatataacacatcccgtaaggcagtgtacttctctctaccttctctggtcacttctagttgcacagttcgttgatcatcatctacgttgtgcgccttcataatgtaatgcttattttgcaaagcattcaacttacgtgaagcagctgggggtgatgtgttaaatttcttagcgatttgcccaggtcggttattcccaagctcgatgatttgttccaaaacgaggaattgatcataagtcaaaccatacgcttcacttgctttgtttaatcggctaattttttgttgtgcatcaagataccactcactgatacttaaaatttcgtgttgctccgccatatggcaattaaatattcaaatgaatttaaagaatcgattgttagcttaagtcagactggccgttcggccaactcactggctaaagaatacaacgtcagtgtttcaacggtcactaagtggattaaacaagctgatcctaacaacactaaagtgctatcatcaaatgaacgtgctctgattaaagaaaataaacggttaaaagaagaacttgatattttaaaacgagcggcagtgctcatggcaaaaagctaagtgttagaagtcgtcaacgctaatttacttgctgggcaccgcattacgcgtatcttatcagtactcaaaattccgcgctcaacctactatgattatctacattggcagccaagtagaactgaacgccgtcggcatttaattaaacaagaagtgttaacggcttggttaagatatccaatgtatggctacccacgattaacgatcttactaaatcaacagtctgatattcacgttagtcagcgtctggtctatcaacaaatgtgtgaattagggattagatctagaatggttaaacgaatcaataagccaaccactcagactgattatgatcagcgaccaaacttgattaagcagttaactgatcaatctggtattttattgactgatattacgtacattccccttaaccatacttggtgttacctagctagtgtctataatccagtaacccgacgggttattgcttaccaacttaatacgcagatgactaaagaactagcgactaacgttattacccaagtcatggcgcaagcagttaaaccacaaattattcatagtgatatgggaagccaatacacaagtgacttatttgaaaacactttatcgaagtatggtatcaagcattcttactcccgaaagggtcagcccggcgataacgcgcgaattgaaagttttcattcaattttgaaacgtgaatacgttaatttccaagattttaagacaattcatgaagcaatcgccggaattgataactatattcgttggtataacagtgatcgtatttcacttgtagcgtagctaaagcgtttttaaaatctgaacggggctaaaacttcggcctccgaaaattaaattaagtaatttaaattgaaagtcaaatttgttcgtacttttatgtccggattcttgacataggagccttaacgttacatcacctttgacggtcaagtttgagtctaattcatcagtaataattgcacccttaggtaaggctactttcgttttaagattcttcaacgtcccttggtattcaaccgtatcacccggtttatagtcggtttcggtcttgaaacttgaatctccattcgtgatattcttaacctttttgctaatctcagccgcacgttctactaagtcagtgtgttcatggttaacggaagtcatccctccactatcgacagcccagacaacaatccgatcaccgacgtgtaggtcatcttcaatccctttagctagaccagaataattcttggtttgtccagccgcaacatctgcgactgatgtcagaactttagggccaccggtcgtgacattgccactagcatctttatgttgcacttcataatagattaattcattcatcttcttgtatttaggatcagctgaatcagttgggtttttgttcgtcactgtcccgtctaagacaacatccttttgactaccatcaacatacattactcgcggcttttgattcaaagtgatttccggtggacttggttgacccccaccatttaaaccaacttcatagccaatatcccgcgattcaccttgttttaaatctttaggccaccagagcatgtcgagttcggtatcgatgtttaccttcgtcgttcgatctccttttgcacgtggtgtcgcaaatcgtttaccaataaaagttgatgggatacttgtgggcgcatttgtgagattaaagccttgccaaccatcaggaccagaaccattgaaaagattaaaatcataaaataaagaagcattcccttcctgatacttagttggaccttctgttgctgaaatatcttgtttctcgtacataccgcgatcaccatcagcaataagttttggcttatctccaatggcacctgacccttggtcactagtccaaaaattccgtaaatcagtatcaattgttcgaccaaagaagaggccttttaaatcacgaccagaagtattggtgatgtgctccttaatgtagacggtcttccaatcagttggttggtacgttacatcatcagtaattgtagtcgcaacaccaccgaccgtacgtgtatattctaaagtctgcttcaaaatagttccttgtgcttctaatgatgatgccgtaacttttattgttccacttgttccaatcgcattatcagcctctaagccaaaaagtaaagttgtcgaggaacttaaatttgtaaaactcaaatcagcttgattgggggcaatcggtgtacctgcaccaagatcaatatcaaatttatttacatcatctttatgaattgacatccaacgtgtgtattgtccaaaatctttcgcaccttgtgcccataaaccaatattattccgtccagcgtgttccatcaaggtcttagtaattggtaccccttgaactttacccgctacaaaattagcataggaaatcgactgatcagtgatagtcggtgtcttacctcgaatcccatcatagttcgtcccatttgtataggctaagtagttcccaccaccaagtgctaacttaccttgatggaatgttagtccagtatcatcagccgccgacaatgatgcactttgcatgaccgacttacctgtcgaattcgaactagagctcttcttactttcttttttctgacttgtactcgaagattgcacaacattctggctgctacttcgaagttgcgaagactcactcacttgtgcaatcgatttactagtatctattattttagatgttgtttcactactattattggcagttgctgccgcaaatacagtacctagtgactgcaaaacagttgtcattaataacaaaattattaataaactatagattattcgcttcttcatttatttagtttcgtcaggaataacaacaaattgcgctactttactaacatcaccacttgaatttttttcttgaacattgatgatatcaaacagtttccagaaagtacttgatacgtttaccaaatatgatttatctgcctgtacagtagttgttacagattctcctgtccgctggttagttacaacaattgaattccctggcgtataaccagttcctttaaccgttttatcactaagttgttggttttctggaacacccggtgctggaatctcaccgcctttatgttgcactgttgctgttgtacttggactttcaccaaacccagcattttgagttgctgaaattgttacaccagcgttttgggctggaattgtaatgctgtaaacaccacttgcatcaacttcgcctgttccaatgattgggctatctggttgaacgccttgccgtaatgtgatttttgcgcccggaattcctgaacctgttacaactgtatctgtgtcataaattgggttatgaattgttggggcttgtttcaagatatcgtaaccaggatctaattgccaaattggaatggttgttgcgccatttgtattaccaactaaatgccaatcgataatacccgcatcatctttatctgtgattgtacttgctaaatgatatgctgatttgtcataagcatctggaatacgtacgcctgtatctgttaccatatcgcctaagttaagatcaaattcaacgtgcatttgaacatttaagccgatacctgttacagtagggttatcaaatttcaataagtatgtgtcatccgattgtgtatctttttcgatatgcatttcatttgatgtgtaactattgttaattgtattgattgatgatgtgtaattgaagtttgctgatgcaatatatttgagtaatgagccatctttagcgaaagcattgaattctcttggcaacttaattgttgttacagtatgttcttgccaattaagtgctgcgaatgatttcacatcatatttcatgtgaagcgtcccacgtgttacttgattgccggcgattaattctaaaccgtccatcgctgtaccgcttgctgctaaagtaccagatgtttgataatcaatacgaggactgttatctttcttagtcattactgatgatgtgtcggcagatgttttagctgcggccatcgctgttgatgttccagctgttactaccattcctaataccgttgatgataccaatactaagtttaccaattttgaacttttaatcatttaacgtaatatcactaaaccaaccgttaataccgccattgcaacaaacgcgagtgtatctcttgtttgccattttaggacgcggtatttactgcggccttcgccaccttgatagccacgggcttccatagctgtcgctaaatcatcggcccggttgaagctgctgacaaatagcggaatcaaaatcgggataatggatttcatttgttgtaagagactaccttctccgaaatcaacaccccgcgcacgctgcgcattcatgatcttcgtcgtttcatccatcaacgtcggtacgaagcgcaacgcgattgataacatcaatgcgacttcatagactgggaaatgaatgacttttaacggcttcagaatcgattcgatcgcatctgctaatgataacggtggtgtcgtcaacgttaagagcgtcgacatgaagataatcagcacgaagcgcatgaagatatatgccccgttgagtaacccgaacttggtcaggctcaagaagccccattgccaatagacggtccccccacgcgtgaagaagatttgaagtaaaacggtaaagaggatgagccacaataatggccggacccctttcaagaagaaactaagtttaattttcgaaattagaattaaggccatcgtgaaaacaaataacaagagataagctggccatgagcgtgctaagaaaatgatcccgatgtaatagaaactggcgattaacttcgcccgcgggtccattcgatggaggattgaatcccccggaatataacggcctaagattagtttattcatttattcattagcgccacctgctccctgcggtaattgatcgcgcaacatcgctgctaattcgtgttctgttaatggtaccttagggaatccaaagcccttcttgattaatgcttgggcaaactgcgtcgtggttggtaggcctaattgcttagacgttagccactcagggtccgcaaaaatttcgcgcggtgtcccactcttggcaatcccgccattttccaaaacaacgacatgatccgcatagttggccacatcgtccatttgatgcgtgaccatcacaattgtcataccttgttcgcggtgtagtttttcaaataaacccatcatttcccggcgcccgactggatcgagcccggcggttggttcatcgagaattaagacctctggctgcatagccaagacaccggcaattgcgactcgccgcatctgaccaccggataaatcaaacggtgattgttctaaaacggcttctggtagaccaaccaattcgaccatcgctttagcccgttcaagtgcctcagcttcaggcacaccgaaattttggggcccgaaggcgatatccttttggacagtggcttcaaataattggctttctggaaattggaagaccataccgactttttgccggatgatcttcaaatttttgttattcgtttcaggcgtaatctggcgatcaccaatctgcacgatcccttcagtcggcttcaacaacgcgttcaagtgttgcaataacgtcgatttgccactgcccgtatggccgattaatgccgtataagagcctgattcaatcgttaaattaatgtgttttaacccaatcccttgaaaaggtgtcccgggttgatacgtataacttacatctttgaatgtaatgtccatttacatctttgaatgtaatgtccatagatgatcaaccatcctttccgttgtgagatagtcagctggcatcggtacaccgagcttagtaagtgctgctttgagtttctcgggataaggcacatctaacccaaggtcaagcaggcgctgcccatatgcgaagatttcggctggtgtcccttgatcaatcacttgtcccttatccagcatgacaatccgatccgcactagccgcttcgtcaatatcatgggtaattgaaagcacggtcatattcgtttcttgtttcaacgtatgaatcgtctcgaggacttcttgacgccccttaggatcaagcatgctcgttgcttcatcgagaatgaggatctcaggttgttgggcaataatgcccgctaatgcaactcgctgcttctggccaccagataaacgacttggttcgcgcgtcataaattgggtcataccaacgcggtcaactgcatcttgaacccgccgctgcatttcagtccgttcaatcccttggttttcaaggccaaacgcgacatcatcttcaaccgtcgcaccaacaaattggttatctgggttttggaaaaccatgccaatcttacggcgaatatcccagacggtttcaatcgataaaggtaagccatcaatcgtaatgcttcctgactgtaaatctaataagccattcagggatttggcaaatgtactcttgccactcccattatgaccaataattgcgacccactcaccagcattgatgctgaccgataaatcattaagggccaaccgactcgcctgtgggtattcatattttaaatgtgccacttctatgattttattttcatccatttaaacaagttcaataataaccattaatgcaccgtcaccacgacgaggggctgttttaagaatacgtgtgtaaccaccatttctttcagcataacgtggagcaatgtcactaaataacttttgtaaagcagattgaacgattactgcttcgtcttcttcgcgaatatcagctacttcgttacgaacgaatgctgcagcttgacgacgagcgtgtaaatcaccgcgtttacctaaagtgatcattttttcagttgttttacgaatttctttggcacgagcttcagtagtaacgatacgttcattgatgattaaatctgtagtcaaatcacgtaacattgctttacgttgagagcttgtacgacctaatttacgataactcatttattcttctgtgcgtaagcctaagccaagatcaaataacttgttcttaacttcttctaacgacttgcgaccaagatttctaactttcatcatatctgcttctgatttgtcagttaactcttgaacagtgttgataccagcgcgtttcaaacagttgtatgaacgtactgataaatctaactcttcaattgtcatttcaagcattttttctttatgcgtctcttctttttcgaccatgatttcagcattcttcgcttcatcagtaagatctacaaagattgccaaatgctctgtcataatcttcgcagctaagctaatagcttctctaggactgatggaaccgtttgtccaaacatcaagtgttaacttgtcgaaatcgttacgacgaccaacacgtgtactttctacttgatagttgacacgactgattggggtataaattgagtcgattggtaaaacaccaattggcatatcgtctgacttgttttgaacagcagcaacataaccacggccttttttaactgtcattcgcacgtggaaattgccgccttcagctactgtacaaatatattgatcagtatttaagacttcaacatcgtcatccgaaatgatatcagcagcagtaactgttgctggtcccttaacgtcaatctcaatcgttttgtcttcttcaacgtgcaatttaagtgctaattttttgatattcaagatgatttgtgtcacgtcttctaggacgccatcaattgttgaaaattcatgtaagacaccatcaatttggatatctgtgacagcagtaccaggtaaagatgccaataagatacgacgtaaagagttacctaaagtcgtaccgtatccacgttcaagtggttcaacaacgaatttaccgtagttagtactttcatcaacctttgtaatgtttggtttttcaaattcgatcatctaaacacgacggcgttttggaggacgagatccattatgaggaactggtgtgacgtcacgaatagcagtaacttctaaaccagttgcttgtaatgagcggattgcagcttcacgaccagaacctggtcccttaacagcaacttcaatagatttcataccatgttccatggcttctttaccagcagcttctgcagccatttgagcagcaaaaggtgttgacttacgactacctttgaaacctaatgaaccagcagatgaccatgcaacagcattcccgttaggatcagtgatcattacaagagtgttgttaaatgttgagtgaatatgtgctacgccagcttcgatatttttctttacacgacgcttacgtggtgcattcttcttgtttgccatttattttttcttgcctgcgatagaaactttcttacctttacgtgtacgagcgttgttcttcgtgttttgaccacgaactggtaaaccacgacgatgacgcatgccacgataagaaccgatttcttgtagacgtttgatgtttaagctaacttcacgacgaagatcgccttcaactttaactgtatctaatgctgcacggatcttgtcttcttgatccggcgttaaatcgcgtgtacggacgtctgttgggacgccagcatcagccaagactttaacggcagttgtatttccgattccgaaaatataagttaaagcaatcacaatttgtttatcacgtggtaaatccacacctgcgatacgagccatctatttaaagcgatacgtaattcgtcccttagtcaaatcatatggtgatagttcaactgtcacacggtctcctggtaaaatcttgatgtaattcttacggattttacctgaaacgtgtgccaaaatcacagcaccgttttcaagttctactttgaacattgcatttggtaaagtatcagttactttaccttcaatttcaatgacgtcatcttttgccacctagtctttaatggtatcaagtacttttttaacggcagcgaacacgtcatcaatttcttgattcccatctaccgtgtaaagcaggttacgtttttcataaaaatcaagtaaaggtgtattcatttcgatattgacctttaagcgattcttaaccgtttcaggtttatcatcttctcgttggaagaagacgtggccgccacagcgatcacatgtgccttccacttgagttggatggtaaagcttatggtacgttgcaccacaagttttacaaatgaagcgaccagataaacgatcagccaagatttcaggatcaacatcaatgttgatcacaccatctaaaggtttgttcaatttatcagtaatcactgccaaagcatccgcttggtcaagtgtccgaggaaaaccatcaagaagataacctacattagtatctgcttgtgaaagacgttcctcgacaattccgtttgtcacatcatctggtaccaattcacctttatcgatgaaggccttagctttaacaccaaggtctgtttgatctgccatagcagctctaaacatatcaccagttgaaatgtgtggaatatgataagcgtcaacaatcttttcagcttgcgttcccttaccagcgccaggaagtcccattaacatgagattcatttatcgaatgaagccaacgtatttccgtttcatgagtaaaccttcgagttgacgagtgctttcaagcgccacaccaacgacgattagtaaactagtcccacctaaaccaattgattgaggtagaccaccgaggtttgctgctaattgaggtaataatgcaattacccctaagaacaacgcaccgacagtcgatagtcgcattaatacgctggagagatatttctcggtacctttacccggccaaacacctgggatataactcccttgtttggtcaagttctcagcaactttttcagggttaacctgaacaaatgcgtagaagaaggtaaagagaataatgagcaccgtataaacaatcgaacctgtcacagtttgcatactgaagatgtctgacataactttgaaccaagcatcttcaccatgacttgcctggaaggccattaagattgtttgaggtgtcataataaatgaactagcaaagataaccggaatcacaccagcaacattgacctttagtggtaagtaactgttgtcacctgcacctgcttcgcgacgtgtatattggattggaatcttacggttcgcttgttgaacccaagtaacgaaagtcacaatgactaataccgctacgattaagccaacaacgaacaagattcctaaccacatttcacccttagaagcattcaagacatgttccttgatgatttgatgaaggccacttgggaggcgcgcaatgatacccgcgaagataatcattgaaacaccattccctaaacctttatcagttatctgttcacctaaccaagtaattaacatcgtaccacccgtaaggatgatcccgatgctaacgaaggtcttaattcctggatctttaaccaagcccatttgactgagtgagttaaagccagcagtaatcccaattgattgaataaacgctaagatgatcgttaagtaacgcgtcacttggttaagtttacgtctcccaacttcaccttgcttgctccattcaacaaatttaggcacaatgtccatttgtagtaattgaaccacaatttgggccgtgatgaatggtgaaacccccatcgagaagatggagtaattcgccaagccaccaccactaacagtatcaagtaaaggaatcaaaccagttgatcctaacttggttaacgcgccagcgttaacacctggtactgtaatctgtgcacctaaacgataaacgatcaaaacgcctaaagtgaacaaaatcttactacggatttccttgactttaaatgcgtttcttagtgttttaagcaattaaatcacctcaattgaaccgccagcagcttctacagcagcttttgcagcttcagaatacttgcttaccttaatgttcaattttttgtttaattcaccatttgctaatactttaacacctgaaagttcgttcttaacaacacctgcttcgattaatacagttgctgtgatttctgtaccgtcttcaaaacgatttaaatcgttaaggttaacgacagcatattctttgcggttgatgttcttgaagccgcgttttggcatacgacggaataaaggcatttgcccaccttcaaagcctaaacgtaccttactacgagccttttggcctttttgtccacggccagctgttttaccagtacctgaagacgtaccacgaccgacacgcttgcgaacatcgcgagcaccttcgttaggtttcaattcatgtagtttcatttagtctttaatttcttcgactgttactaaatgtgcgagtttgaaaatcacaccgcgagttgcagcatcatctggtttgattacagaactatttactcggttcaagccaaattctttgaccattttacgttgttctggaagacgatgagcagcactttttcttaaagtaatctttaatttagccatctagttttgtaagctttctacagagatattacgcaattctgcgatttgttcagcagtcttcatacgagttaaaccgtcaattgtggcacgaataacgttgatagcagttttgctacccaatgttttacttgtcacatcatcgattcctgctaattccatgacggcacgaacagcgccaccagcggcgataccagaaccttcaacggctggttttaatagaacacgaccagcgccaaagcgaccgataacttcatgaggtaaggttgtaccaaccttaggcacattgattagattctttttagcgtcttcaacggctttacgaatagcttcaggtacttcttgagctttaccagtaccgaaaccaacgtgaccgtttttatcaccaacgattacgatagcagcaaaacgtagacgacgtccacctttaacaacttttgtaacacggttgattgaaacaacgcgatcttctaagtctaaatgagttggatcaatgtaagtcatttagaattctagtccgttttcacgagcagctgtagctaaagcagcgatacgaccatgatataaatagccgccacgatcaaagacaacaactttgtggcctgctttaactgcacgttgtgcaactaatgcgccgacttgttgtgcttgttcgactttagttccttctacttttacttctttatctaatgttgaggcacttgctagcgtcacacccgctacgtcatcaataagttgagcgtagatgtttttgttagaacggaaaacgttcaagcgtgggcagtcagcagtaccagagatcttgccacgaacgcgtgtatggcgtttttgacgtgtcttattcttgtctggttttgaaatcacttatttaccagttttaccttctttacggcgaacatgttcatcagtataacgaatacctttgcctttgtaaggttctggaggacgtacatcacgaatttcagctgcgaattggccaactttttgtttgctaataccgctgataatgatgtttgtgtttgatggcacttctacgttaacaccttctggtgcttccatttcaactggatgagaataaccaacgtttaatactaaagttttaccttttaattgagcacggtaaccaacaccgataagatccaatgtcttcttaaaaccttccgttacgcccaaaatcatgttgttcaagttagcacgcattgtaccgtgcattgcacgatcactatcactactacgtgtaaagttgataaggttaccttcttcgtgcatttcaatgattggattgaaatgacgtgttagttcacctttaggtcccttaactgtgatgttgttttcaccgtctttagtaacggtaacacctgcaggaacttcgattacttttaatccgatacgactcacttaccaaacgtatgcgagaacttcgccgccggcagccttttcacgagcttctttgtctgttacgacgccgttacttgttgagataatagcaattcctaaaccatttaataccttaggaacttcgttagcttttacgtaattacgtaaaccaggttttgaaatacgtttcaaaccagagataacacgttcgttattcttaccatacttcaagaatacacggatgataccttgtttgtcgtcttcaatcacttcgtaatcgcggataaagccttcgcgtttcaagatttcagaaatatcttttttaatacgtgaagcaggaacttctaaagattcgtgacgtaccatgttggcgttacgaatacgtgttagatagtctgcgataggatctgtcatgaccatttaccagctggcttttttcatgcctggaatttggcccttatgagctaattcacggaggcaaacccggcaaagcttaaacttacgatatacagaatgtggacgtccacaacgttcgcaacgtgtgtattcttgtgttgagaattttgcaggacgatgattctttacaactaaagattttttagccaattatttagcgaatggcatgccaaattgtgttaacaattcgcgtgcttcttcgtcagtgtttgaagttgttacaataacaacatctaaaccacgaacgcgatctaccttatcataatcgatttcagggaagatcaattgttcgcgtacacctaatgtataattaccgcgaccatcgaatgattttgcactaacaccgtgaaaatcacgaacacgaggtaaagatacgttaactaatttatctaagaaatcgtacattctttcgccacgtaaagttactttagcgccgattggcataccttcacgtaaacggaagccagcgattgattttttagcttttgtgattaatggtttttgaccagcaatcaaacctaattcttcaacagctttgtccaagttcttagcgttagaaacagcatcaccaacacccatgttaagtacgatcttttcgatcttaggtacttgcatgcttgatgtgtagttgaatttttcgatcaacgctggtgtcatttctttaacatatttttcttttaaacggttagtcatttatttatcgattgattctccagttttctttgacacgcgtactttcttgccatcgacaactttgtagcctacacgagtagcttcgttgtttgatgggtcgattagcatgacgtttgaagcatcgatacttgcctctgtatcaacaatcccaccattaggattttgagcatttggcttaacgtgctttttaatggtattgataccttcaacaacaactcgaccttctttaggcatagctttgatgattgtaccttctttacctttatctttaccgctgattacttttactttatcaccagttttaacaaacatttatagaacttcaggcgctaaggaaacgatcttcatgaaatcactgtcacgtaattcacgtgcaactggtccgaagatacgtgttccttttggagtcttgtcatcattgatgataacagcagcgttttcgtcgaacttgatgtaagaaccgtctacacgacgagcacctgacttagtacgaacgataacagctttgacaacttcaccttttttgacaacgccacctggtgttgcctgtttaattgttgcaacgataacatcaccaatattggcagtcttgcgacctgagccacctaaaactttaatagttaaaatttcacgggcacctgagttatcagcaactttaagacgactttctgattgaatcacttagataataactgctttttcaacgacatctaataaacggaaccgttttgtacgtgacaaaggacgagtttccataacacgtacaacgtcgccaacttttgcttcgttgttgtcatcttgtgcataatatttctttgaatatttaacacgtttaccgtattcaggatgtgttttataagtttcaaccatgacagtgattgttttatccattttgtctgaaacaacacggccttggtacactttacgatggttacgactttcttcgctcaattatttgttaagttcttgttgacgtaatacagttttaatccgtgcaatgttctgacgaacttgctttaagcgggcggtattttctaattgaccggtagcttgttggaaacgaagattgaataattcttctttgtattggtgttctttttcaagcatttcagcagtggttaattcaataatatctttagccttcatttagccttcatttgactcgccacctacttcctcgcgttttacgatcttagttttaactggcaatttatgtgatgccaagcgtaatgcttcacgagcaacttcttcagaaacgccgccgatttcaaacatgatcttttcacgttttactacagcaacccatccagcaggagcacccttacctgaacccattcgaacgccgacaccttttgcagtgtatgatttatgagggaaaattttaatccacactttcccaccacgtttcatgtaacgagtcatggcaacacgggcagcttcgatttgacggttggtaatccaacttgattctaatgcttgtaacccgaattcaccaaaagtgacttctttgccaccttttgcagcaccgcgcatcttcccacggaattcacgacgatgttttacacgtttaggtactaacatttatttccctcctttcgtattgttgttggctttagcaggtaatacttcgccccgataaatccaagtcttaactcctaatttaccgtaagtagtcatggcttcgtcccatgaataatcgatgtctgcacgtaacgtatgcaaaggaacagttccttgagcatgtgtttcgatacgagacatgtcagcaccgttcaaacggccggcaacttgagttttgatacccttagcaccagcgcgcattgtacgttgcatagcttggcgttgagcgcgacggaaagcaacacgtgcttccaattgacgagcaataccttcgcctactaaatgagcgtctaaatcaggtttcttgatttccacaatgttgatgtgtactttcttgcctgttaagttatttaaagctttacgtagattttctacttctgagccgcctttaccaatgaccataccaggtttagcagtatggattgaaacgttcacgcgatttgcagcacgttcgatttcaatagtagagacagatgcgtcagctaattttgtgttgatatatttacgaatcttaagatcttcgtgtaagaatgttgcgaaatctttttctgcataccatttagcgtcccaatcacggatgacgccaacacgaaaaccggttggattaatcttttgacccacttatgcttctttttctgatacaactacagtgatatgacttgtacgtttgttgattggtgatgctgagcctttagcgcgaggacgaaaacgtttcaatgttggtccttcgttagcgtaagctttcgtaacaaccaagttttctgcgtctaagtcataattgtgttctgcgttagcgatagctgacttcaaaactttgataacaactggtgaagcagctcttggtgtaaattctaagattgcaattgcttctgcaacactcttgcctctaatcaagtcgattaccatacgcactttacgtgcaggcatgcgaactgacatagcactagctgttgcactagtaatttgatctgccatctagcgtgcttttgttttcttatcgtcatttccatgaccatggaaagttcttgttggtacaaattcgcctaatttatggcctaccatatcatctgagatgaaaacgggaacgtgtttccgtccatcataaacagcgattgtgtaaccaataaagctagggaaaattgtcgagcgacgggaccaagtcttgatgacttgtttcttttcgctgtcggcttgtgcttcaatcttgttgagcaagtgagcgtctgcgaatggtccttttttcaaactacgactcatttatcttgatttacgatgacgaataataagtttctctgaacgagccttactactacgagttttcttaccaagtgtcttcttaccccatggagacataggagaaggacgaccgattggtgctttaccttcaccaccaccatgaggatgatcgttagggttcattactgatccacgaactgtaggacgaatacccatccaacgtttacggccagctttaccaatcttgattaattcgtgttgaccgttaccaactgtaccgaccgttgcacgacatgtaagtaggatcatacgtgtttcgcctgaagttaaacgaacgatagcgtatttgccttctttacctaataattgagctgatgtaccagctgaacgaaccaattggccgcctttaccaggttttaattcgatattgtggataagagtaccatcaggaatattagctaatggtaatgcgttacctactttaatatcagcattaacaccagattcaacgatcatacctacttcaaggcctttaggggcgatgatgtatgctttgataccatctggatattggattaatgcgatatttgatgttctatttggatcatattcgattgacttaacagtcgctttgatatcatccttaatacgcttgaagtcaatgacacggtaatattgtttatgaccgccgccacgatgacgaacagtgatatgaccatgtgcattacgaccagcagtatggctttgggattccaacaacgtcttttcaggggttgtctttgtgatctcagcaaaatctgagctggtcatgttacgacgaccatttgtggttggtttgtacttaataattcccacttaatcttcaaaaatcttgatttcttttgagtcagctgttaatgtcacgattgctttacggcgtttcttagtgtaacccgcatagcgaccttggcgttttaacttgccacgaacgttcatgatattaacgtttttaacgttgacaccaaagatttcttcgattgcgtaacgcacttgtgttttgttggcacgaacatcaacatcaaatgtgtatttcttgtcgtccattgcagccattgagctttcagtaactactgggcgtaaaataacatcgcgtgcttccatttatgcaagcacctcctcaattttagaaagagcagcttgagtaaggattaatttttggttgcctacaacgtctaatacgttgataccatcagcaggaacaacagttacgttaggtaagttgcgagctgataaagcagtaaaatcatttccgtcttcaagaactactaatactttagtattaacatctaacttgttaagtacttcagcgaattccttagtcttaggtgcatcaaagctaaatgaatcaacaacgattaaatcattatcgataaccttttgtgaaagtactgacttgattgcaagacgacgtaccttacgaggtaatttatagctgtatgaacgaggtgtaggtccgaagacaacaccaccgccacgccattgaggtgaacggattgagccttgacgagcacgaccagtacctttttgacgccaaggtttacgaccaccaccacgaacagctgatctgttcttaacagcgtgtgttccttgtcttaatgatgcacgttgcatgatgatagcatcaaatacaacattttcattaggttcgatagcccagattgagtcgtttaattcaacgttcccattttggctaccatcttgtttaaataatgttacgtttgccatttatttatgagctttaacggctgttttaattgtaaccattgagtttttagcgcctggtacgttacctttaacaagaataacgttcttttcaacgtctgtacttacaaccacaaggttttgaacagtacgttggttgttacccatgcgtccaggtaataatttacccttgaagacacggttgataacagcacccattgaaccaggacgacggtggtaacgagaaccgtgacccataggcccacgtgattgtccgtcttttttaatgttaccttggaaaccatgacctttcgttacaccagtaacgtcaacgacgtcgccggctgcgaaagtatcaactttgatttctgttcctacttcgtaatctcctaatgcgacatctctgaattctctaatgaagcgcttaggagtagtgtttgcttttgctacatgacctttagcaggtttgtttgacaagacttcgcgtttatcttcaaaaccgacttggatggcttcatagccgtctgtttcgtttgttttaacttgtaaaacaacgtttggagttgctgcgataactgttacgggaattaattcaccgttttcagtaaagacttgtgtcatacctacttttctacctaagattccttttgtggtcatttaaagcttgatttcaatgtcaacgccactaggtaagtcaagtttcatcaatgaatcaactgtcttaggtgttgggttaacaatatcgattaaacgtttgtgagtacgcatttcaaattgttcacgtgaatccttgtgcttatgtggtgaacgtagaactgtgtataaagttctttcagttggtaatgggattggaccagagattgaagctcctgttctctttgctgtttccacaatcttatcagctgattgatctaaaatacggtgttcgaatgccttcaaacgaatacgaattttttgttttgccatatggataaagctgcgttattgatcatcgactacacgaatgacttcgtcgccccagacggtgccttaacggctggtaagccggctcaagacatcgcatctaccattgtaacacttgcggaccaattcttggccaaaaaacagtttattattttaccaactgacttacatgttgcaaacgaccctttccatccagagtctaaactcttcccacctcataacctcgctgatagccgcggacgcgctttttacggtccactagctaattggtatgccgaacaccaagacagtccctacgtctacgcattcgccaagaatcgctactctgcgtttgcgaacactaatctcgataacttcttacgtgaacggcagattaccgatttacatttaactggtgtctgcaccgacatttgtgtgctgcacacagccgtttcggcttataacttgaattatcccctgacgatccacaaaaaagccgtcgccaccttcacgtcaaacggtcaggaatgggcgctggcacatttcaaaaacagtttaggcgcaacaatcatttagttattggccaccgttcttcttaatgatttcttcttggatgctcttaggaacagctgagtagtggtcaaataccattgtaaatgtcccacgaccttgtgtagctgaacgtaatgttgtagcataaccaaacatttctgacaatggaaccattgcattaacgatttgggcattaccacgtgcttccataccttcaacagcaccacgacgagcagttacttgtcccatgatatcgccaagatattcttcaggagcaataacttcaaccttcatgataggttcaaggatttcagcgccagcttgtttagcagcgttcttcaatgccattgatgcagcgatcttaaatgctgattcattagaatcgacatcatgataactaccatcatataacttagctttaacgtcaatcaatgggtaaccagctaagacaccgtttgccattgattctttcaagccttgttcaactgatgggatgtattcacgaggaacaacaccaccgacgatagcgtcttcgaattcgaagcctttaccttcttcattaggtgtaaattcaacccaaacgtcaccatattgacctttaccaccggattgacgaacgaatttaccttgtgcagatgcttgttttgtgaatgtttcacggtaagcaacttgaggttcaccaattttggcaaccactttaaattcacgtctcatacgatcaaccatgatatccaaatgcaattcacccataccagaaataagcgtttcgcctgtttcattgttggtttcagccttgaatgtaggatcttcttcagcaagtttttgtaaagcaagatctaacttatcacgatcttcttttgattcaggttcaacagaaacttggataactgggtcagggaattccattgattccaagattaatggatgatcaacgtcagtcaatgaatcaccagttgttgtattcttcaaaccgattgcagcagcgatatccccagagaatacttcaggaatttcgttacggtgatttgaatgcatttgtaataaacgaccaacacgttcacgtttgtctttagttgcattcaagatgtatgaaccagattgtaatgtaccagtataaacacggaagaatgttaaacgaccaacgaatgggtcagtagcaatcttaaatgctaaaccagcaaatggtttgtcatcgccagccatcaattcaacttctgaatcgtcttctgggtttttagcgttataagggcgtacgtctaatggtgatggtaggtaatctacaacaccatccattaacatttgaacacccttgtttttgaaagctgaaccagcgaaaactgggaagaatttcaaatcgatagttgcttgacggatcgcagctttcaattcttctttagaaatttcttcgccttctaagtatttgtccataatgtcgtcattaacatcagcaacagcttcaactaattcggcacgacgttttgtagcttgttctaggtagtcagcaggtacgtcaactgtatcccacttagcgcctaattcatcttcgtcatagatatcagcttgcatttcgatcaaatcaataacgccttggaattcatcttcagcgccaattggcatttgaacggcatgtgcgttagcttgtaggcgatcttccaatgttgtcattgaataatcaaagttagcgccaagtttgtccatcttattaacgaaaacaatacgaggtacaccataagtagtagcttgacgccaaacattttcagtttgaggttcaacccctgattgagcatctaagacagtgatagcaccatctaaaacacgcaatgaacgttcaacttcgattgtgaaatcaacgtgacctggtgtatcaatgatatttactcgattacctttccattcagcagttgtagcagctgatgtgattgtaatcccacgttcttgttcttgttccatccaatccatttgtgaagcaccttcatgtgtttcaccaatcttatggattttaccagtatagtacaagatacgttctgtagtagttgttttaccagcatcaatatgtgccatgataccaatattacgcgttttgtctaacggaaattcacgtttgtttgccatttaccagcgataatgtgcaaatgcgcggttggcatcagccattttatgtgtatcttcacgtttcttaacagcagcaccagtgttgttggcagcatccatgatttcacgtgcaagacgttgatccatagtatgttccccacgtaggcgagcgtagcttactaaccagcgtaaacctaaagttgtacgacgttctggacgaacttcaattggcacttggtagttagaaccaccgatacggcgagctttaacttcaagtactggcatgatgttgttcatagcttcttcgaacacttctaatggttcattaccagtttcttctttaataatatcaaatgcgtcatataagattgttgacgctgtaccacgtttaccatcaatcattaagcggttgattaagcgtgaaaccaatttagaattgtacattggatcaggtaaaacgtcacgttttgcaacatagccttttcttggcatttattttttaggtctcttagtaccatatttagaacggctttgcatacgaccgtcaacgccggctgtatctaaagcaccacgaataacgtgataacgaaccccaggtaaatccttaacacggcccccacggataagaacaacactatgttcttgtaggttatgaccaataccaggaatataagctgtgacttcgattaagttagataagcgcacacgagcatacttacgtaaagcagagttaggctttttaggtgtcatagtaccgacacgagtagcgaccccacgtttttgtggtgctggattatctgtagcttttttcttcatactattgtagccaaagtttaatgcaggtgcatcagactttgaagttcttgatttacgacccttacgtaccaattggttaattgttggcatatgttactttatttaatcatcttttatagcggtgcttgttgcgcctcatttctaaccgtttgcgcctggcgcttacccatcgaaaagtccattatcacaccacgttcgcactgcgattgctgtcagcaaccactggcttggcatgatttattaccactattcagctacctatacttacatggccactgccgcacttgtcatgctcagattaagcccacttttttattcagcgaactaattggtggtctattggcctgcttcatttttagcgaatccctttcttgggacctcgcttatttactcgtgattcttttttacatcagtctcgttgacctcttctactatattctctatccaatccccttattcgcatcactggtgcccctcttttatttgtattggccacagaatcattggctaggagccaccatcttttgctgcgggctgttgctcaccacttactgggcgtctggttttggctttggcgatgtcgagttactcactatcctaacgttgtgggtgggccttgaacccgttttgcgaattctcttggcggcctgtctaatttgcattctatttcaaggcatcaaaaaaatctggccatcgcctaaacaagcgacgcgccagattccgtttatcccctatatatcgatgggtgtggtaattctacttctacaaacaccgcagtaattataccttctctaaaaaggtcgtcgtagacatcacttgccccattctcgggaaaatatattgcaagctgtgttggtgttcaatcgccgtgctggcggtcattgcatcttcaatgaagatttggtgatagttatgttcaaacgcatcacgcgccgttgattccacgccaatattggtggaaatcccacataagacgatggtttcaatccctcttctgcgtaattgaaggtctaagtcggtaccatagaaggctccccattggcgttttgtaatttgatgcgcatttttgtagttcgcaatttctgctaataaacgtgtgttcaatagcggtgatggttggcgatagtcaggtgtccgttcccctaaattaggcgttagttgatcttgtccgtctgtgacgccaacatttacgaggacaacaaaaccttggtgcgcttcaaagtcttcgattagttgtcgggcgttttgaacgaccgtttcacccgcatgaggtgcgagtgttgggcgatccgcaatgcccggctgtaagtcaatcaccactagggccgttttggcataatcaatggttgtcatttattcttttgtttcttcttgtttcatttgtgcttcaatgtcactgattgagtaaacattttctgatacagcaccgactgtcttaggttccatatgacgatacttcgccataccagtaccagctgggacaatcttaccaatgataacattttctttcaaaccaagtaatggatcgctcttaccgcggatagaagcatccgttaagacacgagttgtttcttggaatgatgcggctgataagaaactatttgtttccaatgatgctttagtaataccaagcaagacaggacgacaagtagcaggtacgccaccgctaattaaggtatcgtggttacggtctgtaaattcactaatatccattaatgtaccaggtaagatttctgtatcacctgggtccatgacacggactttacgtaacatttgacggaccataacttcaacgtgtttatcgccgatttcaataccttgcatacgataaaccttttgtacttcatgcaagaggtagttttcagttgataatacatcacggactttaattaattgcttaggatcaacagacccaccagtaattttttcaccacgatgaatcatgtcgccttcactaacaatgatgtttgacgtataaggcacgctgtatgaacgtgtatcagtttcgccttgaaccgtaatttcacgtgtgtgttctgctgggttttcttcaacagcaatcacttcacccgttacttcagtgatagtagcgatagctttaggattacgtgcttcgaaaatttcttggatacgaggcaacccttgagtgatatcttcaccaccagcaaccccaccagtatggaagttacgcattgttaattgcgtaccaggttcaccgattgattgagcagcaacagtaccaactgcttcaccaacttcaacttcttcgccattagccatgttacgaccgtaacatttcttgcagacaccatgttttgtattacatgtgaagacggaacgaattgtcacttcttcaacaccagcatcaacaacagcttgagcaagttgttcatccatcaattggttcttagcaaccattacttcacccgttgttgggttaataatcgtcttcattggacaacgcccaacaagacggtcatacaatggttcgatcatttcattaccttcacggagtgagtgaataagaagaccacgatcagtaccacaatcttcttcacgaatgataacatcttgtgcaacatcaactaaacgacgtgttaagtaaccagaatcggcagtcttaagagccgtatcagtcatacctttacgggcaccatgggtagacataaacatttccatgacagagagaccttcacggaagtttgatgtaacaggaacttccatcatcccaccattaggagcggccatcaagccacgcataccagcaagttgcgtaaagttagagatattaccacgggcaccagaatcagacatcattgagattgggttcgttggatcaaatgaatccgttaaacgttgttggatatcatctttagcgtcgttccaaatttcaataacacgcgcatggcgttcttcatctgtgatcaaaccgcgacggaattgtttagaaatcgttgtaactttcttatgagcgtcatcaacaatttcttgtttttcaggtaattgaggaacatcggcaaccccaactgttaaaccagcatgagtcgcttgaacgtaacctaaggtcttcatgtcatccaataaatcagatgtccgttgaaccttatataccttgaagacttgcgcaataatatcacttaagaaacctttcttaaatggtaagattacgggtgcaccagccaagtaatcatgaatatcttcaccgttgtcgatgaaatacttgtcaggaacaccattcattaagttatctgttgttggttcatttaaatatgggaagtcagctggcatgatttcgttgaacatcactttaccaacactcgttaccataatcttgtgacgttgatcatctgtaaatggacggttagccatatcagcaactgataaaccaatccgactgtgcaaatgaacgtggccagtttgataagccatcaagacttcgtttgtatctttgaagatcatgccttcgccgagacgatttttttgttcaagggttaagtagtagttccctaaaacaacatcttgagatggtgtaacgattggcttaccatctttaggtgccaagatatgatgagcggcaagcattaacattcttgcttctgcttgtgcttcgtcagataaaggtacgtggatagccatttggtccccatcaaaatcggcattgtaagcttcacaagctaatgggtgaagacggattgatttaccgtcaaccaagattggttcgaaggcttgaataccaagtctatgcaatgtaggtgcgcggttcaatagaactgggcgttccttgataacatcttctaaaacgtcccaaacatcgtcgtcttgacgatcaattttacgtttagcattcttgatatttgaagccatatcgcgtttaaccaattcgtgcatcacaaatggtttgaacaattcaagtgccatttcacgtggtaacccacattgatagaacttcaatgtagggccaacatcgataactgaacgaccagaataatcgacacgtttaccaagtaagttttgacggaaacgaccttgtttccctttcaacatgtgtgaaagtgacttcaatggacggttaccaggtccagtaactggacggccacgacgaccattatcaatcaaagcatcaacggcttcttgaagcatccgtttttcgttttgaacgatgatgtttggtgccattaagtctaacaagcgtttcaaacggttgttacggttaataacccgacgatacaaatcattcaaatcagaagttgcaaaacggccaccttcaagttgaaccatcggacgtaaatccggtggaataactggaatagcatccattaccatccagtcaggacggttccctgacttacggaaggcatctaagatgtctaaacgacggatagcacgtgttctcttttggccttgagctgacttcaagttttccttcaattcagcgacttcgccttcaagatcaacgtcttgtaacaattctttaatggcttcagcacccattttggcgttgaatttgttgccatattcatctaatttttcacggtattcgcgttctgtcatcaattgtttcttttcaagtgctgtatcacctgggtcgataacaacgtatgatgcgaagtaaataacttcttccaaagcacgagggctcatgtctaagacaagacccatccgactaggaatacccttgaaataccagatatgtgtaacgggcgctgctaattcaatgtgacccatgcgttcgcgacgaacttttgaacgtgtaacttcaacgccacaacggtcacagacgattcctttataacgaatccgtttgtacttaccacaagcacattcccaatcttttgtagggccaaagattctttcatcaaaaaggccatcgcgttcaggttttaaggtacggtaattgattgtttctggctttttaacttcaccatatgaccaactacggattttgtctgaagatgctaaaccaatttgcatgctttcaaacttattgacatctatcaattattctgctgatggatcttctgcacttgctgcttgtgctttttcagcttcttgttgcgctttcttttcttcttgttcttttgcgtatttagataaggcatcaacgttaacaacatcgtcatcatcgtcatccatatcgcgcaattcaatttcttgattatcgatatctaagactttcatgtctaaaccaagtgattgtaattctttaaccaatactcggaatgattccggtacaccaggttttggaattggttcacccttaacgattgcttcgtatgtcttcacacgaccaacaacgtcatcagacttgtaagttaagatttcttgtaaggtataagcggcaccgtaagcttcaagggcccaaacttccatttcaccgaaacgttgaccaccaaattgtgctttaccacccaatggttgttgcgtaacaagtgagtatggtccgattgaacgggcatgaagtttatcgtcaaccatgtgggctagtttcatgtagtacatgacaccaactgacacacgtgtatcgaatggttcaccggtacgaccatcataaagaatgctcttaccatcagaaggcatgtttgcttcacgaacagcatcccataaatctttatcttgcgcaccatcaaagacaggtgttgcaacatggatacctaagtttctagcagccatccctagatgtaattcaagaacttgtccgatattcatacgagaaggcacacccatgggactcaataagatatcaactggggtaccatctggcatgtatggcatatcttcttcaggaacaacgattgaaacagtccctttgttaccatgacgtccagccatcttatcgccgacttggatcttacgtttttgtgtaatgtaaacacgaaccatcatgttaacacctggtgataattcatcgccagcttcacgcgtaaagatcttaacgtcttggataataccgccgccaccatgaggtactttcaatgatgtatcgcgaacttcgcgggctttttcaccgaagatagcgtgcaatagacgttcttcagctgataattctgtcacacccttaggcgttaccttaccaactaaaatgtcgccgtctttaacttctgcaccaacacggacaatcccgaattcgtcaagatccttcaatgaatcttcaccaacgttaggaatttcacgtgtgatttcttcaggtccaagctttgtatcacgtgcttctgattcgtattcttcaatatgaattgatgtatacaaatcttctttaactaagcgttctgaaagaacgatagcatcttcgtagttatacatattccaagtcatgaaagcgatcaatgggttttgacctaaggctaattcgcctttttccatagctggtccatcagcgataatttcatcaacatcaacgtgatcgccttttgcaacgattgggcgttggttgtagtttttaccagcatttgaacgacggaatttcattaattcgtacgtatctaatgagctgtcttcacgacgaacacgaataactttcgcatcgacatattcaacagttccggcatgttgtgctaataaagcaatccctgaatcatgggccgctttatattccatcccagtcccaacaagtggtgcatgtgggttaaccaaaggaacagcttgacgttgcatgttagcacccatcaaggcacggtttgaatcatcgttttccaagaaaggaatgcaggccgtagcgacagcaactacttgcttaggcgaaacgtccatgtaatctaacttgtcgattgatgtttcgatattgtcatccttgtaacgggccaagaccgtgttatcaacgaatgaaccatcatcgtttaatggtgagttggcttgcgcaatgacatagttatcttcttcgtcggctgttaaatagtcgatcttatcagtaacatcatgtgtatcccaactaacacgacgatatggtgtttcaatgaagccataacggttaacaacagcgtagctagctaaactattgatcaaaccgatattagggccttcaggtgtttcgattgggcacatacgaccataatgcgtatagtgaacatctcgaacttcataaccggcacggtcacgagtcaaaccaccaggtcctaaggcagatagacgacgtttatgcgtcaattcgccaagtgggttggtttgatccatgaattgtgacaattgtgatgaaccgaagaattccttgattgaagcaacaactggacggatattaatcaattgttgtggtgttacggtgcttgtgtcttggattgacatccgttcacgaaccacacgttccatccgtgataaaccgatccggaattggttttgtaataattcaccaactgaacggatacgacggttacctaaatgatcaatatcatccgttgaacctaaaccttcttgtaagttaaagaagtagttcattgaagcgatgatatcagcaggaatcacatgtttcactttggcatcgatatgaccattaccaattaagttaatttctttatcaggtgtcttttgtgagtaaactttaatgacttggagtgtcattggttcaggcaagacgccttcgtcagaaggttggtaagtaacagctttgaagtcttcttgatctaaataaggtgccaaggcatccattacttgacgatcaacaagtgtatctttagcagcaattacttcgcctgtgtcaggatcagccaatgtttcagccaatgtttgacccaataaacgtgtcttcaagcttaatttcttattgatcttgtaacgaccaacagaagctaaatcgtaacgtttagcatcgaagaaacgggcaaaaagtaatgaacgtgaactatcagctgtcttaggttcgcctgggcgaagtctttcatagacatctttcaaagcttcttccgttcttgagtcgtcagtattcttatggatatctttttctaacgtcaacattaatgaatcgttgtcgcccaagatatcgataatttcttgatcagacccgtaacctaaagcacgtactaaaacagacattggaatcttacgtgtccgatcaatacgaacgtatgcaatatccttagcatctgtttcaaattctaaccaagcaccccggttagggatgacagttgtgccgtaagttgtccggctatttttatcaatagcactgttgaaataaacaccaggtgaacgtactaattgagaaacgataacacgttctgcaccattaataatgaaagtcccttggtctgtcatcaatgggaagtccccaaagaagacgtcttgagatttaatttcaccagtttcatggtttgttaatttcaaagtaacgtgtaatggtgctgaatagttggcatcatgttgtcttgcttcttcgaccgtatatttaggttcaagaagttgataatcaacgaattctaatgataagttaccagcaaaatcgtcgattggcatgatgtcatcaaacatttcacgaagcccttcgtctaaaaaccattgataggaattagattggatttcgatcaagtttggtagttccaacacttctttaatccgtgcatagcttctacgtgtccgatgtttaccgtaattgactaagtgtcctgccaatcactgacgctcgtcgaaataggccaatgctttgcccccataaaccgtaccaggaccacccgacatcatgacggctgtgttgattgtttcgatcacttcatcccgattaacgccttctttaatgaggcgattcatgtgactgaggatgcagccttcacaccgagtcgcaatcgcaatccccaatgcaatcaattctttttccttcaccgttaaggcaccatctttgacgttagccttgtgcaagtcaccaaacgcccccatcacttcgggcgatgcttctttgagtgccgcgtattccttcttaccggtttgtgcctgttctgaataagtcatatgaagagaatgagcacagtattactatcaatcggcactatcgccctcttattagcgggttgtcaaggcaaacaagcaagtcaaggtgattctaaagcgcagtcggctaaaatcacagcggttggatcaacagcactgcaaccccttgttgaacaagctggtgcaacttatcaaacaaaacacgctggcatcgacatcaccgttcaaggcggtggttccgggaccggcctcgcacaagtcagcgatggtagtgtcacaatcggtaactctgacatcttcgcagaagaaaaagctggcatcaacgctaagaagcttgttgatcacaaggtcgcggtcgtcgcaattgcccccgtcgtgaacgaaaaactcgggatcaaatcattaacacaggcacaattaaaagacatcttcactggtaaaattaagaactggcacgcagttggcggccctgaccaatcaattaccgtcgttaaccgcgcacaaggtagtggcacacgccaaactttcgaaaatctcggtcttaaaactaataaagtcatgacgagccaagaacaagactcatctggtactgttcaaaaaatcgtgcgtcaaacacctggggcgatcagttacctcgcctttccttatattaaggatggtttgaaagctgtcgcactcgataacgttcaaccaaccactaaaaacgtcctcaccaaccaatggcctatctggtcttacgaacatgcttatactaaaggtgcacctaactaccaaacagctaaattcatcaattaccttcaatctaaagacgttcaaaaaacacttgttccaaaactcggttacatcccaatgacccaaatgaaagtggaacggcatgctgatggcagcatccaagacgttaaataaatgataaacaataaaatgaaaacgctatccgataaatacccaactaaaatggccgtcacttctgaaatcatcaatctcaaggccatcttaaatttgcctaaaccaaccgaggcctttatgagcgacctgcacggtgaatacgacgccttccagcatctcatccggaccggcgctggtaatttgcgccaaaaaatcaatgaactcttctccggtgagatgacacccgagacaatgcaagccttcgcttttctcgtctactacccaaccgaacgattagcgctcaagcacaaggccctttcagagaatgaattaaatcagtggtacctgacgacttttaaacgcatgattgacctgcttaaattcgtttcaacaaaatacacacgttctaaagtccgtaaagcgatggcccccgacttcgtctacatcaccgaagaattaatgtacggcgatgttgccaatgttgataaaaagcgttacttccaagaaattaccgcgaccattattgaattaggccaagccgacgcgttaatcatcgccacaagtcacacgattcagcgcctcgttgttgatcaatggcacatcattggtgatatttacgaccgggggcctcatcccgatttgattgttgaccaattaacccaattgccagcggtcgatgtccaatgggggaatcacgacattctatggttcggtgcggccagtggttctgaactttgtttgctaaacttactgcgaatttgtgcccgttacaataacctcgcaatcattgaagaaacttatgggattgatttaaccgacttggtccgttttgcggcccaacactatcaagctaattccgccttcatgccggttgaagatcctaatcaaggcccactaacgcgtgcggaaaaactaaaaatcagccaggtccaacaagcgttagctatcatgcaattcaaactcgagttaacggtgattaaacgccatcccgaattcaacatggatcaccggctcctattgtcgcaagtcgactttaagcgccgcatcttgcacctcaacgggcaggaatatcccctagaaaacacctgtttccaactggttaatcctgagaaccccgaagctttaacggcggaagaaagccaaatcatcgcggatttactggccgccttcacgcgttgtcagaaattgcgtaaacacctgacctttttaattgatcacggtagtatgtaccgcatttacaatcaaaacttactctttcacggctgcttgcccgtcgatgctgagggacacttcctgacattgaccctcgctaatcaaaactatgtcggcaaacaactgctcgatttctttgatcaacaaattcgctcgagtttcaaccaccccttacaccaagcaaacctctcgacagacttattatggtatctatggacggggccgttgtcaccactctttggtaagaacgcgatgacgacgtttgaacgttacttctgtccagatcccgagacccacgttgaaactaagaacgcctattacagtctgcgccacgacgctgattttattcagcaactcctcagcgaattcaatctttctcctgaaaccggtcatatcctaaacggccacacgccggtcaaaaaaggccacgaccccattatggctaaccgccagatgattgtgattgatggtggcttttcaaaagcttaccatcacacaactggtatcggcggctttaccttactctataattcttacgggatgcagctggtgactcaccaacccttcaccaccaaggcggatgcgattgctaatatgaaagacatcatctcaacacggcgggtcatcgaccaagttagccaacgccaacgagtgagtcaaaccaatatcggtgcggccatcaaaaccgaaatcgaacaactccaaacattgctaacgattcaaccggatcattaattatttaacagttgttttttcttttttactattaatggtaatttcacctttggtagccccaattgtcactggtgtatcagtcgtgatttcaccagccaataaggcttcactcaagcgatcttcaacttgcgtttgtaatgcacgacgaattgggcgcgcaccgtattctggatcaaagccggctttagccacaacatccatcgctgcagcagtcatcttgatcttgacaccttgttccgctaagcggtttaagatgcctttggacataatcttgacgatttcacgcaattcaggttgtgttaatgaatggaagaccaccgtttcatcgattcggtttaagaattctgggcggaatgacttcttcaattcttccaaaatccggccttgcattgctttgtaatcggcagtgacatctttgaccccaaaaccaactgacttgtcatcacgtaaggctgttgcccctaagttagacgtcatgatcatgattgtattccggaaatcaactttccgacccttagaatctgtcaaatagccatcatctaagacttgtaacaagatattgaagacgtctggatgagccttttcaacttcatcaaaaagaacaacggaataaggtttattgcggactttttcagttaattggccaccttcgtcataaccgacgtaaccaggtgctgccccgactaaccggctcgtactgtaacgttccatgtattctgacatatcaacccgaatcaagttgtcttcagacccaaacatggcttctgccaatgctttggccaattcggtcttcccaaccccagtagggcctaagaacataaatgaaccgattgggcgcttaggatccttcaaaccactgcgggcccgacgaattgcacgggccacagctgaaatcgcttcttcttggccaacaacccgttcatgcaagactttttcaagttgcaacaagcgttcgctttctttacgttgcaattgagtgactggcacacccgtccattgggcaacgacttgtgcgatatcttctggttggacttgaatatctgtccggacaccattttcttgttcggctgcttggcgcttagccattttagccttagcaataatttctttttcgtgaatggcagcggctttttcaaagtcttgtgcaccaactgcgacttctttttctttcgccaacgattgcaattcagtttctaagcgatcgattggtgatttttggttaacagcatctaatctgacctttgcagccgcctcatccatcaaatcaattgccttatcaggtaagaaacggtttgtgatataacggttcgctaaaacaacggcttcgtgtaatgcttcatcagagattgtgatgccgtgatgttcttcataacgtggtcgtaacccgcgtaagatttgttccgcatcttctggtgttggttcatcaaccgtcaccgtcgcgaagcgccgttctagagctgcatctttttcgatgtatttttggtattcatcaagtgttgttgcaccgattaattgcaattcgccacgggcgagggctggtttcaaaatatttgaggcgtcaattgcgccttctgccccaccagcaccaattaaggtatgcaattcatcgataaagaggattacttggccatcttcatggatttcttcaataatcttcttgagacgatcttcaaattccccacgatacttagtgccagcgactaatgagcccatatcaagcatcattaaccgtttttgttgcatgtcgcttggcacatcaccgttgataatccgttgggcaaagccttcagcaatcgctgttttaccgacaccgggttcgccaactaaaacgggattatttttagaacgacgtgctaggatttgcacgagtcgtttaacttctgaatcacgaccaacgactggatcaatttgattttcgcgggccatttgggttaaatcgcgtgccaattgattcaaagtaggcgtgccttcttgatcaacctttttagcactggctttagcgcgtttcttagcagttgcagcatcaatccccatcttttggagtaataattgacgtgttttggctaaactgaggcctaagtttaatagaatacgagccgcaataatgtcatcatcgcgtaataacgctagtaataggtgtgccgtcccgattttgactgagttagcttgttgtgattcaacgcgcgctaaatctagcacttgtttagctttaggtgagtatggcaaatagccgcccacacccatggcaacgattgaatcaccataaccggttaagcgttcaatttcttctaagacatcagtgggtgtcacaccgagttcacgtagtgcgttcccagcaatcccttcgctttcgaggacgagcgctaataacagatgttccgtccctaatgcatgatgattaaacttcttagcttgttcttgcgctaacattaaaacgtttttggcacttggtgtaaatagattattcatttacttaatttcgtaacgtaatctttctaagacagcaattagcattcgtgcgcgtaattgctcttctaactgcttatcattgacggctaatgtctgcgcattgagcattgctaataccaaattcccctctttttgcgataaaatctgctcatcatagagtttttggataatagctaatgtatcggcttgcgagattcgatcctcaacactaccaatcaacgcttctaaaaagtcgcgatcatctaagaattgaaccttaacgatgcgaatgtagccgcccccgccacgcttactattgacgacataccctcgttgttctgtaaaccgagtattaatcacatagttgatttgtgacgggacacagttaaatagtttagcaatttcggagcgtcgaatttcaatctgctcgctgtcagccaatattttttttaaataggcttcaataatatccgagatattctgactttgcaactaatagaagtcttccaagcgttcataatctaatatttcaacctgtcgaccttgtctttttatcaattgccgctgttctaattgcttcaattgccgtgataaagtttccggcgtcgtcccaatataagtggctaattcttttaacttcatcgggattttaaccgtcaacgtctcactgaccttcaccaaagccaataaataagtcacaattcgcgattcaaccgattcgatattcatcagattagcttgttgttccaacttaatcatcttattagccgttacttctaaaagtttcaaactaatttccggataagttaatagtagttcttgaaaaggtgcgcgcggcaatgtgcagattacactgtcttggagtgcctcaccatatacttgttcctcctgattcgtaaagagcaacttctcaccttcaaagtcccccggttccataatccgcaatagttgttctttacccgctgcggataattgataaaccttaatactcccactagccagaatcactaggcgtttttgcgcagtcggactaatgacttgctgacccttagtaatcttttcgtggtgcgttaatgccgaaatcttcaggagactgttgtgattaaggtgactaaatatcggtactagttctgcacaaatatgttgttcaatagttgccacttagtcatcatcttcttcatctaagccttcacgtgcatccttaccgagttggctctgcaatacacgaatttgatgttggttataacctagcatatcaactatatcagctgccaaagcaaatcgttcttctttttgggcgagcttgatcgcccgtgatacgaataggttggcggtgttaaaatcgttgaccaattccgccatcatagcaggcacatcccaatacttgatgcgggcatcttcagtaagcatcccgtattcagtatattctgcttgcgtcgtcgggattacttcaccctcatccaataatcgttcagccgtcttatctaatagcatatcattttctgttaataaagttgccacttgtgccttgaagatgccattatcaatccctttggcagaccacttcatctgacggagtttgcgccgttggattgtgagattggccataatgtggccgatcattgcaccagctgttggtgtatggtgatccacatccgcttgtttcagttctgcttggtaacgttcttcaattgccgctgttgttaacatctatttaaccttcacacttttaacgttgtagcccagatccgtaaccacttgggtcaattgttctgggttagtcgttgtttcatcatattcagttttcactttgcttgcattaaatagtactttgaccgattcgacgcctgcttgttgactgacacctgcttgaatcttttgcatacatgatggacatgagagttcatctaattgcattactaacttcgccatttagcgaactttaaaccgaattaagcgcatcgcatttaaaatgacgactaaaatactgatttcgtgaacaaacatcccactggccatttgaacgtagcctaaaatcaatcctaatagaagtaacgcgaccgttccaactgcaatcacgatgttttggaccgtattatgggctgtcgccttagtgaggtaatcggcgtagacgacttcagaaagtgtcgattgcatcaatacaatatccgacgtttcaattgcgacatctgtgccggaacccatcgcgattccaatgtccgcaagcgctaatgacggactatcattgatgccatccccgataaaagcgactttttgaccttttgcttgatacgtcttcaaataatcaaccttctccgctggtaacaagttcgcgtgaaattctgtgatccccacttcgcgggcaatggctgccgctgtttgttcattatccccggtcagcatcacaagatttttaacaccggcctttctcaaacgggccaaagctgctttggcttctggtttcaccgtatccgcaatcccgataatcagtgccaacgtttgattaatcgccaccaacaccgttgattgcccagctcgttgactggcttcaatcaccgcgcgttgttgcttattaatgataataccggcgtccgtcaataactgcgcgcggccaattcgaaccaattgttccccaacttgggctttaacgcccagtcctttgagcgtttcaatgtgagtgacaatcggtaaagccgttaagccttgttgttgggcataactaaccaccgccagcgctaatggatgatccgattgcttttcgacggctgcggctaatttcaaaacaatcgcttcatcagccgcatagttcacaacttgtgctactgccgtttcacctttagtgagcgtccccgtcttatcgaaaaccattgtatcgattccggccatcgtgttaactacctcgccgcctttaatcaagacgccgtttttcgcaccgttaccaatcccggcaacgattgaaactggcgcgccaatcactaaggcacctgggcaacccaacactaaaatcgtaatcgctaatttaaaatcgcgtgtgatcaagccgaccactaacgctaataccaacactgcgggtgtgtaataagtcgcaaaacgatcgataaacttctccgccggtgatttactatcctgcgcttcttccaccaattcaacaatttgggcaaaagtcgtgtcatccccaacttgattagcgaccacggtcagcgtgccattgtcgacaatcgcgccagaatagacgctggccccaacttcttttttaaccagctgtgcttcacccgtaatactggcttcattaacaaaggcacttcccgtgataaccgtcccatcaactggcacctgaccacccgctttaactaaaacgtgatcgccaattgccacatcgtcaacatcgactgccgtcacagtgccatcatctgcgaccacttgtgcggtttgaggtgccatctccgataatgaccggattgattcccgagtttttttaagtgttcgttgttcaagataactcccgaataagaacaaaaaggtcacaatcgccgattcgttgtattcgccaataacaaaggccccaatcaccgcaatggtcaccaataaatcgatgctcaccactttgaccttcaaggcttggtaagcctgcatcaaaatcggcgccaccccaagcactgaagcaactaacagtaacccttgcatcacaacaaccggcccacctaaccagtaccaaccataagccaccgcaattaagacccccacggccaacgctgtttgattcttaaccgcctgcaaccatctttgaaatcgcatttagtaaagctttttgttagattgcgccttgtaaataatcattatcaaagaaatcagactaactacactaatcacgtgccccaccttttgaagcggcgtttgctggtaaaagaccgtcacctgcccactgccctttaaggtaatttgcgttaagccattttgaggattcatttgcatcggtatcaatcgtttctcatggttaatggtagcaacgtagcccttgtaataaataaacgggacctcgacaaccgctttttggtgcttaagcgtcgtaaattcgaattgatactgcccccatgtatgccggacattggctattttgactttagcaggttgatactgaatcacttgctttttatgcttcaaaatcttttgataatccgtctgttcgggtagatactcatgccctgcaccaatatagtacggattaggttgattgtattgcgcattggttctaaaacgccaactttgattttgaatactgtttgtcgcataaatgacatttccgacgcctaacatcagaataatagcgtagaaatagtacttattattcaataattgcaaatcatccttggcaatcaagtaactgacgattgctgtgatgattgcaaaaaaacgccatggaaattggattgtattaataatcgtatggtcgaataattgccaaggcatcaatggcgtgaccattataaacaggccgagtgcgatcacaattaaatcaccgtcatttttggaccgccagaataggtaacacgctactcccaatcctaacaaaatcgtgattccaacattgactgtattcgcgtggaaaacggcgttggttaacgaattacggaccacttctttaaaagctagcgtgcggtctgataaaaaggctagcggttgagcagaaacttgaaacgttgtcgttgccatttgttcgcccacggctaagaagtaatgcgctaataggccaagtgacaacccaccggatgctattaaatacttaaaactaccatttttgtagagcgtcttaaggttcaacaacgtgtagatcacgatgaaaatacccatcatttctacagaaatcatatggctgtaaccaatcgcaaccatccccacagctagcaggtaccaatgctggtgcttaccagacttcaacctggtcatcattacaatgactaacggaaaaaaggtcagcgcgatgacttccccgattgcctgacggttaactaggtcagcaaaacgatagatactaagaccatacagtaaagcaaagattaaggccttcttcctactaaaccctgctaatttaccagaaccgtaagtcaccagaaaagtacttaaattgataaaaattgcgaagatcacgaaactttctttaatcgacaagcccagcactcttaaaatagctggtagataaagaaatgtatctggataaaaaagactcgcagcataacccatcccaccaatgaaaaagtaacttattttagggaaaaaatcgccatgcttaattgagagcgctaagttctccactctattcatgtgaaaatgataatcggccccagataaaatcttattaggttgtaaataaacaatggcgaccattgcgatactaacgattagaaaaaataagaacgttacagttacaacgtgttgacgataaaaattttttaaaccaatcatttatttctgattgtattgttttaacgctaatgcaaaatctccaagtgttgccgatccattgttctcaactaacggcatcgttatataatcttctaacttagggacttcaacataattgtttaattgttctttaaattgcaatctaactttatctaagaagattttattaactaccccgcctcctaaaataattttattagggcgaataatcaaggtttgttgcaccacagcttgtgctaaataataggccataatatcccaaactgggtctgactgatcgacatcctgtccttttttgcctactcgcttctcaaaagtgggtccagcaatcaatccctctaggcaatcaccgtgaaatggacagattccttcaaattttaaatcatccggatgtcgttttacgagaacgtgtcccatttcaggatggcccaaggttccaattaactgaccatcaataatagcaccggcaccaacacccgttccaactgtgtagtaaactaacgaatcaacaggttgttgcgctatccgagcagctacatattcaccgtacgctgagccattaacatcagttgtaaaaataattggccgtgcaagttctttctttagataacctacaaaatcaacatcatgccacccaatcttgggagtatttgtaatatatccatatttagcgtgatttttccgcaattcgattggcccaaatgaagcgactgttattactgtcacatttgggaattttttaaaaaaggtgactactcgcgctaaagtttcttgtggcgttgtcgtcgcaaatgttactttatccttaacttgatagtgctcatctcccacggcacaaacaaatttagttccgccggcttccacactgcccactaataattcactcatttacttttcctcattcccgatagctacaaccaacgcatcatacggctgtaatacaccacttgtcgctattttatttaataataaattattgctaataattttttgactaggcccgaagtgctgaatgggtagcgtataactttctctattcttagataagttaataataactaaccaactctgttctcctaacatccgtttgtagctaatcacattttgattacctgttggtacattttcaaatcggccttggcgaataattgcgttacgttttcgtaattttattaactgctggtaagtcgcataaatagaccgttcatcttgtttggccaattcaacattgatttctaaatagttaggatttaccggtaaccatggtgtcccatctgtgaaacctgattgattcttaccattccattgcatcggatgccgcgcgttgtctcgacctttagcattaatcccatttaggatatcacttatcgcatagccttgttgctgtcgttgttggtaaactcgccgactctcaatatcctcaatttcgtgataactcgtaattggataattggtcatgccaatctcctcaccctgataaatatacggtgttcctttaagcatatgcaggtaaattgctaatgcttgcgcacttttttcacgatactggctatcgtctccccaacgtgacacaattcgcggtaaatcatgattactccaaaataatgagttccaaccaacgccatctagcgctaattgccatttactaaataccgcatataactctgctggaataagtggttttaaatcccagcgagtcatccctgattgtttatctaaattaatttgttcaaattgaaagatcatcgatagttcgtggcgattaggattactgtacatctggccaatttcgggtgttgccccccatgtctctccaaccgttactacatcatactgtgaaagtacccttgcgttcatctcttgaagatacgcatgtaattgtggtccgttttccttaattttgcggtcaggttccttccctatcaaatcaataacgtccatcctaaaaccaccaatccctttttgaagccaccaagtcatcatctggtagacagcttctctaactttaggattttgccaatttaaatccggttgttctttcgcataaaaatgtaaataatattgcccagtaaccgcatcaaacgcccaagctgatcctttaaaattactttgtaaatcattcggaacactaccatcggttgcagggtctcgccaaatataaaaatcacgatacggattatcttttgattttcgtgcttctaaaaaccatggatgttggtcacttgtatgattaacaactaagtccataacaattttaatcttacgaatcttcgccgcttcaattaactgctccatatccaccatagaaccatattccggattaattgcctgataatctgaaatatcatagccattatcaacattaggggattgataaactggtgatagccaaattgcatttacacccagatcagctaggtaatctaatctttgaataataccttgaatatcaccaattccatctccattactatcttgaaaacttcttggatagacttgataaaatactgcattttgccaccagttagtttgcatttaatcctttttagcgtgtaattgaataatttcttcgccttgcatagcatccttgtcgactgttaaaagcggatcaacttgtgcatatcccgctgtattcgtcacaatagtcattgttagcggtgttagccctgcttgtttaatcttatcaatatcaaaatgacctaataaatcaccttcgctaacatgttgtccctgttggacaatcttttcaaaacctataccatttaaattaactgtatctaaaccaatatgaattagcacttctgcaccatcatccgattttatcccgtatgcgtgaccagtatcagccgcaattgttatcacaccggtaactggtgcaagtacatcctgagaagttggcataatcgcaatgccttttcccattgcttcacttgcaaaaactggatcaggtactgatgctaagtcaacaattcgtccggtaactggtgcactaatcttttcatcttgtaatctctccactacttctggggtagctggtgcttcattgattatttcttcttcagttgtcttcattgcctttttaccgtataagtatgtccccacaaaggcaattacgaaactaataatagctcccatcataaaactagggatgctcttaggtgcaatcgcaataaacccaataattcctgcaggtcccattgatactgataaaacatgtaataaaccaataataaacgatgagattcctgatgcaattaaaccaataaagaatggaaacttcaattttaaattaaccccaaataatgctggttcagtaattcccaacatcgcagaaatcccagcagaagtcgttaatgacttttgttgtttattcttagtaacgaagaatacagcgaaagttgcagccccttgagcaatatttgccatcgctgcaacgggaaaaataaacgatccaccagttttggcaatatctgccaaaagtgtcgtttcaattgccgggaagctttgatgtaagccagttaagacaattgctgaataacccaggccaaaaatccccataccgactgcacctaacgtttgataagcccaaactaaactatcagtaacaccatttgaaacaattctcaatgcaggaccaactaatgtaaaggttaaaaatcctgtgataataatcgataacattggtgtaaacgtaaaatcaacagcatcatttaaatgtttatggaagaatttctctaaattagcaagaatgaaggcaactccgataaccggaattacttgaccttgataaccagcttgcgcaatattcaatccaaagacatgccaatacgtcatatgccctgtagcgatactttcagcaaccccataaccattaactaggttaggcataaccaacatcattcctgctgccgcacctaaatatggatttccaccaaatcgcttagttgcagaaaatgcaattaaaattggtaggaaggtaaatggcgctgacgacatcatattgacaatctcagcgaatcctttccactgtggaaacatctggacaattgattgtgcgccaaacaagccttgacctgtcaaaacattattaatagccattaataggccgccagcagttaaagctggtattaatggcacaaagatatcgcttaaaaccttaatgaacttcataataatattgtctttattatcagccgcaatattttttaattcttctttagaagcttctttaatatttacaatcttaataaattcgtcataaactgtattaacatcccctggaccaacaataatttgatattggccattcgcgttaaacgtaccctttagatctggatcattatctaatgctgcttggtctattactttcacgtccttcacaactaatcgtaacctagtcgcacaatgagcagccgcaaccacattatcttttccaattgcctgagctattcgtttcgctacttccttatgattcatatgccattaattacaaactggacacgtcaactacgctatcaaccttactcagattggtccatcgattatcaacaacaattgttgaatcgtgtccaaaattcaccctatcgtcttaattaccatattcagccagatacaggtttattaaatgatcccaacggtttctcttatttcaatcaccaatggcacttattttatcaaaattatcctatgggaccagttcacggtctaaaatcctggcaccatcttatttcagatgatcttattaattggcgcaaagcaactcctttattacctgacggaaatttcgatagtcacggcgcgtattctggtagtgcattaccaattaacgatagactcttccttttttataccggtaacgtcagaaatagtgactgggagcgaacaccttttcaaaacggtgcatggctaagtcaagcaggtaccatcagcaaaatatctgaacccctaatcaaacaaccacgccactataccgatcatttccgagacccaatgatttttaagtatcaagaccaaatcatggcgctaattggcgctcaagataacaataaaattggtaagattgccgtttttaaagcggatcacaataacattaatgattggcgcccactcggcgaattagcttttacaagtgaaaaactaggttacatgattgaatgtcctaacctcatctttattaatcatcagccggttttaattttttgcccacagggtttaacatccgaagttatttcttaccagaacatctatccaaatatgtatgtggttggtcattcattcgaactcaatacaaccaccattacgcagccttctgagcttactaatcttgatgacggctttgactgttatgccacacaagcttttaatgctccagatggtcgtgcactggcagtaagttggttaggtttacctgaaattgaatatccaactgataaagacggttgggctcattgcctaagcctagttaaagaattaacactccatgataatcaactttatcaataccccgtcgaagaaacaaaagcgctccgccaaacaaaacaaatcctatcactcagtaaacaaagcataatacctacaactaacgcttatgaattagaactcgaagtgccggcaaacactagtcaaacactccacgtctttagcaatccctcaaaatcaaatggtttagtacttactatcgatacaacaaatggtaaaattacaatggatcgttctaacgctggggtctcatttggccaacaatatggtcaaatcagaacaactaatgttcaaccccatcatcctattcatattaacttattcgcagatcaatcagtcgttgaactttatatcaaccatggtgccaaagtcatgagtagtcgcctattccccacggaaaatcaaaatataatctgggcagaaataccacaaaaagcacaactttggcctttatctaaagtaaataacaactgagtgcctacaaaactaacggatgttgccaaattggcaaaggtcagtccgacaacagtttctagagtcattaacaactatggttatctcagccaaaaaacaattgataaggttcatgccgctatggccgaattaaattatcaaccgaataatttagcaagatcgttacaaggaaagaaagcccaaatgatagggcttatttttccctctgttagtaatccgttttttggagaattaattgagcgcctcgaaaagaaactttttgataaaggctacaagagtattctttgtgatagtaatcgtgagcctgaaaaagaaaaagcatatcttggtatgttagccgcaaatcaagtagacggtattattgcaggaggtcataataccgaactacaagaatatgaaaaaatgagtgcaccagttatttcatttgatcgactattgagtacacatattcccattatttccagtgataactttgccggcggtcaaatcgccaccaataccttgatcaacctcggtgctaaacggattggtattattactggcagtaacgaaactaattcaccgacacttttacgacttaatggctatttagatgcactacaaaaaaatggcttagatccttttgtcttccaaattaaaagtaccacttcgaatagtcttaaaaaaattgaaattgcgcgtattctacgtgaagaacacttagatggtcttttttgtactgatgatttaactgctatttccgtaatgaatgaagcccaaaatcaaaatattaagattcctcaagatcttaaactaattggctacgatggtactgagttaattcagaaatacttcccacaactaacaacaattattcaaccgattgacgagattgcctcgctgttagccgaactaattactctacgtattgaggatcctagtgctccattagagatgcgctatacactgcccgtaaaattattacaatctaattcaatttaactaacaagacttaaaatgatagacaactgtatgaaaatcggtcttatttcgaggtaacgttaatccaacattcattaactcgtccccaccatattgttcacctgaatcagactgatataccttattaggatctaaataatttaatttaaataccggataatgcggtgctgcttgtgctagttcactgtaaatcaacacattaaattcactacgattttcattgatgatcaaccaagcagtgtagttatcatctgtaacaactaagcgatagaaccgaccaaattgagttaattgccgttctttttttgcaattttggtttgttgtttaatctgttgtttctcatcagcacttaattgcgttaaatcaagttcatagcctagattcccaaacctcgcaatatcaaacctcgtctgtatatctgttgttctacctacttgatgattaggaactgcactcacatgtgcagccatcgtaattggtgggtatagtaggctatagccatcttggataacaactctgcttggtgcatctgtattatcactcgtccaggtctgtggcatgtaatatagcatgcccggatcaaaccgcccacctccgcttgaacaaccttcaaataatactgttgggaactcattcgtaatcacttctaacacatgatataagcctaaaatatatcggtgccaaacctcaccttgttgactatcatcgactgccgtactataaacatctgacatatgtcgattcatatcccatttaatataatctatttttccagtactaagatgttgtctcagcatttgtattagataatcttgaaccgctgggcgtgtcaaatctaacactaattgatttctaccttccatcggttcgtaatttggaacatgtaaacaccagtctggatgctgacgatatagattacttttccgtgaaatcatctcaggttcaaaccacagtccaaataacaagccatgttgcttaatcgtatccgctaactgtccaattccatgtggtaatttagtctgatcaaccgaccagtctcccaaagatgtcgtatcatcattacgcccaacaaaccacccatcatccaaaacaaatagttcgataccaacatcagtcgcttcttgcgccaatgcttcacatttagcagcgtcaatcgcaaaatacattgcttcccaagtattaattaaaattggccgttcctggtggctaaaacgtcgcggtactaaatgatcctgatataattgatgaaaattctgactcattccgtttaaaccagccgtactataattcatgatagcttctggtgccacaaatgtttcattcggtgctaagcgccaatcaaatgtatctgtattcaagcctagctgtgcgcgaatattaccgtattgatcttgctcgacttgtcccatgaaattaccactatagaccaaatgaaatccataaaccacaccagtatattctgttgttttaggtgataaaagtgcaaaaaaaggttggtgttgcggactacttgccccacgaacactttctattttttgaatgcctggacaaataggatgttgattgcgattagcttcattaatatgtgccccgtacaatgataaccaggatagcttttgaggtgtaaaatcgattgataagctttgacaattctgaattgtaattgctcgttgtccaacattcgtcacttcttgatgcgttgcgataatatctaaatccttaaagattgtataatacatcgctacccgcacaccggctttcaaatcctccaaattaatccggagtgtttgtgcatcatcgtcactaacaacataagttgccggcaagtcacttaacttgggcttcccagtaattatttggtaatcacgatattctaggtcaaggtggttattgtgactagcttgttgaattgttaaagcagggattcgataatcacccgtatctcgtgttggacaaatcagtggtaactcacctaacgaaaccgttcgatccgtcgatggattaacagctaatccacggtccgtaaaccggatagtgttactttcatgatactgacgaatatgagcaccaaaatagcgatgaattacatatttttgttgaacgattgctaagaccatactgatacgcccattatctaggtaaaatattgcctttttttcatcaaaactaatcatttggggcttaatcattcttttcagctgcactatgatcacacacagtactttcatttaatcggtggcggaaatgaaactgtcactgcaaattattattgggactgtcgccaaagaactgggaactattgcctttttcaatatacaattaaaggacaaggtcatttacaaattggcgatagtcattacaccctaaaacccggtgacgcctttttagcgacaattcctggtaaccagatttattcattagcgccagatagtataaattggcaatttatctacttggaattctcaccacattttattgatcaatggcaccaaatgacacaagatacgcccatactgaactttaaggaacatcccgtattcgttaaaaattgtctagcgttaaatcaaataggtctccaaaatacgtttagtgattatttcgaaaatacaagtcgatcagcacaatttttctttgatctcttacgaattagtcaacatactcaccaatcggctcaagataaatatccagaatggttaagccattaccgtcagtggctagatatccactacgatcaggacatttcattagaagatgcggctgatatttttaataaatcaaaatacacactcattaaagcctttaaatattactaccaacaatcaccaaagcaatacctaattgatttacgtataaaaaaagcaatgcgtctactcatcgagcatcccgaattaaccgtcaagacagttgcgcaaaagtgtggctttcagtcagccaattacttcaccaaagttttccataaaaaaacaatgtattctcctctaaaatttgctcaagaaaatacattgcacgatagtagtgttcattattttaataactagttattttagcgttagttcatattcctcatgtctcttagggtcaacctgcgttgtgcccggaatgaaatgaatcgcttctgtgcctgcctctctggcttgatggtaataccacttcttccaccgtaagaaagctaagttcgtttctaatgccttaattttggcttccaactgacgttcgtgttcgaccataaaatcgtaacgatcaggtagcgtttcatcgcccaccatacaccagtcaataaactggccaatttctttaatcggaatggccgattttttcaaacagtcgatcacttcgacgtaacctaaatcgtcatccgtaaaaattcggcggccagccgcgtttcgtttagcaaacggcaataacccttccttgtcataatagcggagcgtatcaaccgaaacgcccattttagttgcaatctcaccaattaaataagttgtcatatgaataaaccattaatcgttattacaggcgctagctcaggctttggtgccggaatcgctaaaatttttaatgccgctggctacccagaattactcctcgggagacgaacagctaaaattgaagcattacccttaaacttcgaaaacgtcttaattgaatcagtcgacgttactaatcaagcccaatttaaagcagctatccaaaaggctgaagcaaaatttggcccaaccgatttactcgtcaacaatgccggtgtcatgttattagggaacgtcttgactcaagatggcaaggaatggcaaacaatgctcgacacgaatgtcatgggcgttttaaacggcacacaaatcgtcttacctgctatggttgaacgccaacacggcacaatcatcaatatgtcttcattagcaggccgcaaaactttcgtaaaccatgccgcttatgtcgcttctaaattcggtgtgcacggtttaagtgaaacaatccgcgaagaagtctcaggtaaaaacgtccgaatttcaatggtcgcaccaggtgctgctgaaacagaattattgacccacgttactgatcaaggtgccctaacggattatcaagcttggaaagatagtatgggtggtattaccttagatccagtacacgttgctgaatctgttaaattcatctacgacatgccacaagctgttaatatccgcgaactcgatatcgcagcaactcgtcaagatagctaattgccaaaatatgaagagatcgccgacacacttcgccagcggattaagcaaggaatttatcctgctaattcgttgctacctaatcaggttgaacttgtcgaagaattcgatgctagtcgcatgacggttaaaaaggccattacgattctcaccatggaagggctcgtttttgctcgtcgtggcgctggcaccaaagtactagaccattctttttgggacaaaaacactgcaccagccgatcaatatcgcgggatgtcgtttgatttagccgatgctaatcaaacgctcaccagcaagatcattacctttaaagtcactttcccctcacctgaagttaaggaacgccttaccttgagcgcgcaacaaccggtttacgaaattattcgcttacggattgttgacggcgtcaatagcgttctagaacatacgtatatgccggttagcctcgcacctggtctaacagatgaaattcttgaggattccatttatagctatctgaagaaggatcttcatctgacatttgccggtggtttccggaatatccaagcggacaaagctgataaatatgatcaagaatatctcgactgcgcaccaacagatccagttttagaagtcgaacaagtggtctatctcgatagcggtcaaccaattgagtattcccggagtcgtaaccgctacgaccgccgcggttatacttacttggacgttaataactgctaattatttttcaagatcttgtaatttttggttgtcatctaatactgaacgaccgccattaccgattttttgtaaatgattcataccgaaccacaataggatcaatgcgactaccataaatagtagtaacgtgaagactgtttgtagcacttgaccgttacctaaaccagatgtgattgcttgtctgaagcctaggattgagtaagtcattggtaagaatggatggattacattgtagaagtggtttgtaatttccattgggaatgtcccacctgaaccacctaattggagcatcaagagaaccatggccaagaaacgaccaggattatcgaacgtcatcgataagaacatgatgatcgccatcgacgtcaatgagaacataattgatactaagaagaattgagcaggatgatcaacatttaaacctgcgatcatcatcaaaccaggttcgatgattgccatgccgacagcaactaaggcgccgacagaaatcttacttaagtaccaagctgttgctgattgaccagtcattgaaatcttccgaattgggaaggcaaagttgaagacgattgccccaacgaataaggctaatgaaagcacatatggtgctaaagcatgaccgtagttagggacatagctatagtttgagtgtttcaattcagcaggtgcagcgaacatatccgctgtcttattcgttaattggatatcgttaacttgttttgcgccacccttaagggcagttgctaatgtcttgttaccatcagttaactgaccagcaccgtcgtttaacttagctgagttagcagctagttgacttgtaccatcggctaattgaccaacaccactcgttaacgttgggatcttagcgtttaattgaccaagaccaccgttcaatgtttcagaacctgttgccaattgactaacgccacttgttaattgtgggacttggctattcaattgaccagtaccagttgctaattgttttgaaccagcagctaattgaccaacaccgcttgtcaattgtggcacttgaccatttaattgtgttgtaccagcatacaaggcttttgaacctgttgctaattgaccaacaccgcttgtcaattgtggcacttgaccgtttagttgtgctgtaccagcatataaagcttttgaacctgttgctaattgaccaataccacctgtcaattgtgggacttgaccgtttaattggctagtaccagcatataaagcttttgagcctgttgctaattgactaataccacctgttaaggctgggatttgaccatttaattggtttgttccggcagctaattgtgtaccacctgcaactaattcaccgttcttacttactaatgcttcagaaccattagcagcagttgcgacacctgttgtatatttacctaaaccagcgatcactgcttgtgaccctgtttctaattgactaataccagcatctaacttagctgcaccagatgctaaaccaggattgccctgtgcatcatcgttcaagccagtttgaattgctttaagactacctaacattgaaacagaacctttaacagctgctgttaactgtgcgtattgtgcagctgttggtttcttagcatcaattttagcattgataccagaaacaatttgttgtgcttcatccttagctgaagcggagagttgtgcactcaacttagctttaatgcctgcttcttgttgtgcactgaagacaatacctgcttgtttttcagcatcaataattgcttgtgcttttgcattgaaatcagttgttgcaacaacttgatcaggaatcgcatttaaatctgtttgtaatgcaggaatcgtactttcaacttgagcaatcataccatttaatgctgtatattgcgcaacggctgcattataacttgcatcatctttgaatgttgggttgctgttaagttgtgattgcatcttttgtaacccagcagaaatcttttgactacctgcttttaagtctttaacaccagatgctagacttgttgcaccgttatttaaatctttgttgtttttagcaagttcttgtaaaccatcatttagactacttgtgccatcagtataagctgttacacccttacttaagctagcagcaccattatttaaatcttttgcacctgaggctaaatcgcctgttttaccatttaatgtttgtaagcctgtatttaattgaccagcaccattatttaaatcttttgcacctgaggccaatgcgcctgttttaccatttaacgtttgtaagcctgtgtttaattgaccagcaccgctattcaattgactagcacctgaagccaatgcgcctgtcttactatttaacgtttgtaagcctgtatttaattgaccagcaccgtcgttcaattggcttgcgcctgaagctaatgcgcctgtcttactgttcaatgtttgtagacctgtgtttaattggttagcaccgctgtccaattggctagcacctgaggctaatgcgcctgttttgctgttcaatgtttgtagacctgtgtttaaggcccctgaaccggctgctaatttttgaataccgtctgataaaggtgtcacgctagttttcattgtcatgacgccatcgttgaccttatcaacaccagctgtataagtgttcaagccatctgaaagtgtgactgaaccctttgttaacttcttagcccctgaagcggctgtgctgaagcctttaccagctgttttaacttgtttgaacataacttgagcataagcctttgttactgtttcacgtacttgggcgttcaattccttggcacccatttcactgataacttcaccgatgaagttcaatgaatcgtttgtttcatattggatttgcatctttttaggattcttatccaaaactgttgcggcgtttgctgaaaagttcttaggtaaagtaacaactgtatagtattccttatccttcaaaccttgtttagccttcttggctgaaacgaagcgccaacctaattggtcatttttctttaattccttgaccatgtccttaccagcactcaacgtttcaccgttgtaagttgctggttgatcgttatttacgacagcgactggtagttcaccagtgctaccgtaaggatcccagacagatttcaggaaaaagacactgtacaagaacggaataaacacgattgcgattaacgaaatcatgatgattttattcttggcaatgaacttaaattcattttgaatcatcttcatctataaattttgcttagccataattctttgtgtgatatatccaaagagaatcatcgcgatgatttgaatgccgtaaatcgctagataatggcccatttcgtttacatcaatcgttggaattacaagcaatgcaaatgacgttatgatccgataaacccaagtaagaccgatgaaaaccaaaatggctttttttgcccctcgcatccaagtgcaggccaacaacatcaatgtcaccgttgtgatataggctagaataagatcaatcaaataataccaagagaaattattcatgaatgacgagaagacgagttgcagcatctcgatattcttattcaattcaatgactagcaaggtccctggtactaataaaaggacaactgcggctaacatcgataagcaaatcgtcacaatcaatttggcgtagaataaatgtttccgtttaatcccagaagccatcatcagggccaaaacatcgttattatagtcgaccgataaaacgtggaacggataccagtataataagatgaaattagcagctattaacagcataatactaataatcataaatgagccaaaggttttattgccatataactcagctggtagtgattgtgcgtttgccaatatcaaggcaaaaataatattgaggaccgcaataatcccaaaaattaacatatatactttttcatggaaaaatttgaagaattccatttttacaattcgttggatcgtcatttagtttaatttattgtccaatgcacttagtacgccaatttcattgctctcaatttcagcatcaattaatttcatttggacttctcgccacttaggatctttaatcgataattgaatccgaccgtcggctaacacttcatgttcataagccatttcggttaaaatcgcttgaacttttgcattatcagtcgtgttgaccacccgtagtttcttgtcactttcggtcgctaaatcaatggtttcacgcaattgaccgtgatcaatcacaaatactgatttacagaacatttcaatatcactttgaacatggcttgagatgagtaaggtcattgacccttcgctgatcaatttttggagatagttcttgaaccattgtactgtctctaaatctaggcctctaaaaggttcatctaaaataagcagttcaggttgatgcaataacgcgattaataagattaatttcttcttcatcccgtaagaataagttttaactttttgatccaagaccgcttcaatgccgatttcagcagctaatgtgcgcgcttgttcatggttgaattcaccacgtaagccactaaaataagccaaattaaaccaaccagtttgattcatgtaaactgacatgccgtctaagacaatccccacccggtttaaaatagctggattatcgcggacgttttgaccatcaatttgaatttcacccgaataattcgtaatgatattggttaagctcttaaataacgtcgttttaccagcgccattatgaccaacaatgccgtaagcaccgccatctggaatggttaagttttttaaatccagtgcaacattatttttatacgttaccacaagattattaatttcaatttgcatctagccaatttttgtcatgccgcccatgtatggtaccaatgcttctgggattgtaacagtaccgtcttcattttgatagttttccaaaatagcagcgactgtccggccaaccgctaatcctgaaccgttcaatgtgtggaccaagttcacgtggccatcttcgtcacggtaacgaatttgggcgcgacgtgcttggaagtcggtacaatctgaacagcttgagatttcacgataagtattttgagcaggtaaccaaacttcaatatcataagtcttagctgatgtgaagctggcatcgcctgttgccaatgtgatgacatggtatggcaagtccaatgcttttaagatattttcagcatcgttagtcattttttctaattcattaaatgattcttcaggttttgtgaatttcaccatttcaactttgttaaattggtgcatccggattaaaccacgcgtatcacggccggcactcccagcttctgaacggaaggctggtgataaagctgtgaagtagattggtaattgtgcaccatctaagatttcatcacggtagaagtttgtcaatggcacttcggcagttggaatcaaggtcattggttcgccttcgttagtcattgtgtaaacatcttccgtaaacttaggaaattggccagtcccaaacattgattcgccgttaaccaagtaaggtgtaatcatttcttcataaccttctttggcatgttgatccaacataaagttataaacggcccgttcaagacgtgcacctgcacccttgtaataaacgaaacggctgcctgaaactttagcagcacgttcgaaatctaaaataccaagtttttcaccgatatcccagtgtgctaatggttcgaaatcaaattcacgtggtgttgaccatttacgttcttcacggctgaagctttcatccaaaccaactggtgctgaatcattagggaagttaggtaagcgaaccaagatatagtctactttttccttcacttcagctaattgtgcatctaattctttaatttctgcaccgacgttcttcatagcagcgatttgttcagttgcatcttccttattgcgtttagcaacagcgattgcttctgaagcagcgtttctatttttcttcaattcttctgtgcggacgattaaagcgcggcgtttttcatctaaggcaactacctcgtcgatttctgcagcatcaataccgcgagtcgctaatttatcctttgcccattggacattttcccgaattactctgatatctaacatttaatcggctgacttttgtaaccaaagctctcttaataagccatataaacgcccataatggtcactatccgcattttgattccacttaaacatcactgcattcgggttaaccttattggctaacgagatacttgacgttgtgatgactagatcggcatcagccaaatcagcatcgtcgtgcgtcactgtcacataacgaatattcttcaaagccatcattaaatcaaaataacctaagaatgattgttctgatactaagacgaccttcaccgggttagtaggtgctacccgttgaacaacttgccgtaagacattataaagcccgctaacaatttgatcgcgtaaatcgctgataaaatctaattgcttgtctaagagtaagtaatcgaccgtatcttcaatatcttgttttaaaacggggttatccctcaagcgtgtgtaatcgtccattaaatggttcgccataatcgacatcacatcttgtttaaacatatagattgtcatgacagtggccattaatgtctgaactaatccttgataatcttcttcatccaggttcaaatgttcttcaagattaattggcaccttagccatgaaatccattacgaatttatgggtcttaggaatataacgttcatagcgatcttcataagatggcatatactgattattcccttgtaacaagatgggcccaaagttcatcaagtcataaaggttaaaagattcagccattgcttcttccatcgtcatctgagccattgcatttttaataattaacgctggcccaatgaacggttggttaatatacgttttaatcatattggggactgggtaccgcaataaattttcttcggtaggtccttgaatatagtgccgctgcgcaatccgatagtacattgtcacaactaagtatgcacctaattcgcgggttaaaacatttggttttgccaattggaaccgttcgattgctaaatcaaacgcctttaaagcatccaatcgatcaatcgtttcaaatggccatgtgtgcccatcagtcgctagccagaataaaatgatgaggactaagcgaatcttattctcatcaccttctaggcgaattggatcgtaatacatgcgaatatcaaatgaccggattaaatcccgaacacctttcaaatgccgcaatgcggttgctttgctgatatcgtgtgatgtccaaaattcttcgaacttcacttcttcacctttcaacaagatgtttacaaaatcaaaaacatctgattgattcactaaatgatagtgataggcatctagtgggacactaaataatctttgaatatcttcagtgtcttcgccgataacttcttttaaatcagcgacgatactcatataggtattatatagactaccataagtccggtttaataaggcggcgacctgttttaaattaacgtcgtcgactaatggttcattttttcgagataatgcaattctttttttgacgggtaattcatcccgcttcaagctcgcgatatccaacaacagaccatatttatcattttcagcctgtgttaaaaaaatactgtcatttctattcaaatgacattgctcgtacttgctggcacaattggtgcaggaaaaactagtttaacaaaatatttatctgatcatttaggaacggaagctttttacgaatccgttgatgataacgaagtattacctttattttataaagatcctacaaaatacgcttttttactccaaatctatttcttaaataaacgatttgatagtatcaagcaagcttacacagatgataacaacatcttggatcgctcaatcttcgaagattcattactcttccacttgaacgctgatctcggtcgtgccacagcaactgaagtgcgcgtttacgacgaattgttagccaacatgatgcaagaattaccatttgccgcccacaagaaacgtcctgatttattaatccatgtccgcgttagtttcgaaacaatgctctcacggattcaaaaacgtggtcgttcttatgaacaattagaagccgatccaaccctctacgactattacaaggaattaaacagccgttatgacgcttggtacgacgcttatgatgaaagtcctaagatgcaaatcgacggcgacgtattagacttcgttgaaaacgaagctgatcgtaaaaaagtcatcgatatgatcgaccaacgggttaaagaattaaacgaacaacaatctaaagcaatctaatcaattgagctcagatttttctaagtgtgatttttgaatccataattcgtgaacaatcccgtataaacgagcgtaatgatcactattagcattcaaccgccaaacaaacggcactgcttctggattggtataatctggtaaggtgatgctggccgtagtaaccactaaatcggcatcccgtaaggcttcatcactagtgctgacatcaacgtattgaatgttatccaatgccgccaagacatccatataacctaaataatcttgttcaaccactaaagcaaccttcacacggttagccggacgatactgttgaattaattgtcgcatcaagttatagtacgctttcacaagcgcatctcgattaggttcaaataatcgaaattctggttcagataagagataatcgactgtctgactaacgccagcccgtaatcgttcattgggccgcaataattttaagcgttccattaattgatgtgatgctacggaagtcatatcattacctaacacatgaatattagttgtgaccacaaataaggcattttgtaactcgtgatagactttatctgatgtcttcaaatagcgctgaatatcaattggcgtccgttccaaaaaatgacgaacaaaatgataaacttctggtacataacgttcataaaccatacattcagtaatatcaaactgttctttcgattttagcggcattggtccgtatttcattacaaaatacaacccggccgactcagcacgacactgtgcaggtgataattgcgccaatgttgcccgtaaattaattgaatcttccgtaaaatcagcaaccagataagtattagtcaaatcaggatatggataacgaatcaacgacatccgatcgtcttcttcaataatctttccttgcatcactctataataagaaatcgcgatcatataggtgccaatttcacgcgttaataagttaggctcttctagttgataggccttaactgcacaatcaaacgcatcatgcgccatttgttggtcaacgtcatcaaaaacccatgtatgtccaccagccgcaagccaatataaggtcaccagcgcaatccgaatcgccttttcatcaccttctaagtgaattggatcatacgcaatccgtacattaaaggctcgaattaaatcccgtacctgtttcaagtgccgcaagacggttgccttactactcttgtgcttctcccaaaatgattggaacgacacgttaccaccatgtaataaaatttggacaaaatcataaacatccgaatttttaaccatataaaaatgataggcgtcactcggtaccttaaagagctgccgagcatcatcagtatcggtccctaagaccgcctgcagatcgcccaccatgctcatgtacatattatataaactaccgtagttgcgatctaagagcgccgcaacctgttttaaattcacatcatcaatcaggtaatcaacctgtctggccatactaattcgtttcttaacgggcagttcatcccacttaacgttagtaatatccaagaataatgcgtacttttctttctcagctagcgtcaaataaatactgttcgtattcatctaaagtgtcaattgccaccccattggtgctgtgtatgcattcgacgatactttatagtcatttctatatggtaaatgaagctgcagtgagctactcttgagcggattattactcatcttcgtttctagactctgcggtgtcgtatcccgtttcaatatgccatcaatccactcaccatcgcttttatctggcgctagtggcactggtgctgcggtattgatattatatttaaaattattggtaatataaaacggattttgacttgtcgcattcgcgtctaaataggctaattttaggttaaatccgcttaataacggattataaacaactacccttggttcttccggtgttccggtatctgcgactgctttttgggtcaattgaatctcgttgatagcaaccgttcttgttgattcaccagaagaattacccaaaatatccgtgccaaatgatattttagcaggaacagtcacttcgagagacgcatcaatctgtaacgtgaatttaaacgtcgcagtggtttcaatcttatccgcagcaattgttgcctccttggcatccgccgttgttgcaaattcaatcccgctagttttagtgagtggataactaatcttctgtgcctcagttttcatagttcccgccgtcgccttagtctgattatttaaatcagccaataaactttcttgatctagctttacagaggtcccagtttgagcaccatcagaataacgataccaatcacctttatcattattaccgttactattatatcgataatataagccatagctgtcaggtacattcgatagttttaaggtccctgtaattcctagactaggtgcaggcttcaaagcaccatcagcgtaatcaaacttagccgtcccaccgctcttaagcgattgagaattcttgctaccaggatcatttaaatcgatggaatcaatagtaatttttttgacatcccctccatcatttaaatccggaaattcttggttattaccaaaaacagctttatcatgctctggcgaaatcggtgcgttgtccagtgtgatattattagccgcaacaactcccccaatataaaggcccttattagcactattagcatagtaagatccatgaggtatcaacatcgttccaaaaagcatagttcccgtactacgattggcatagctaaccgctgctgtcttatcagtaatccctgaattatcttgtttatcttgtttatatgattctggattatagttatctgaatcataggtatcagtaaaattatcaagtaaatgagccccaaatgttaagacatttggattatcccattcttctgcattactagcccctacttcggtcgctatgcttcttatatggtttcccgttcccaaaacagataagttatctgtaaatatatgatgattaatatcgccaatgtagaacccatcacccggttggaaatcaaatcgtttatcaccaaaaccactataatttaaaactatatatggcattttatctggatctaatactgacttaccattttttttagtgtagaaactatctgaaaagttaaagataaggctcatatgtttggcatctttattataatctagtacctttgcacgatcgattgaaatcgcaataattggtttctttccattttctgtggcggtataggctttagtttgatccctgaccgcttgactgactgtcggatcatcttttttagcaacaacgttgattacaatatcagaaacgtcggtccattgatcagcaatatagactgggttagacttttccctaaccgtcgtattcggccaatcatcggtatatgattgttttaagttcataatttggtctgtgctggaccagaattcagagtcttcgggaagtaaattcgcataaaattgactcacatcctggatgttttgctgtaagctgtatccctcagtagtatcctcacttgtttcatacttattaatgccattatctacatattgcggaatcttcgctaagttaccatttatattgggtactaatttatttgaccataaattagtgattgttgccgatggtatataactgggtttccctttatcagcctctttagaatattcctttattacttcagaggcagtcgtatccgtagcaaactctgcatttttagaaagtacatccccggtaatattgtcccgtcgccacatgccacccaaactaactaacagattttgcatactattagttcggttcaatattttgtcattactcttattaaaatcattgataataacggctggattttctaagtttttaaaataattatcatacttcgtgtcagtgctcgaaagtcttgaaccatttaaacctggtggatcaatattagcacccactttcagtataatagaatttgccataatccggccactaaaagaagcctgattatggataaactggtttcccgcaaccatcataaaatttgaggcgccacttagtggatattccgtatcaattcgtgccttattcttaatcaccgtctcagctgcctgaacattttgatggttaacaaaacttatcgttgcaaaacaaccaattgctaatgcgattaaaccatattttctttttgtcatttattgtttttttagttctttgatttgcttttcatcttgcttcttacgacgacgataccctaagtaatacgttgtaattaacaggatgatgaaaataataattagtagaatgattaaccaaatccaccataagtctttattcttacgatttaatttcattgcttgtccgactgtgatttcgaaatcttgatcgaaaacccacgtcttttgatccgacttagccactaagtgtaagtgatgtttccctggactaatccaattattccccaatggaataccatattcaaaactagaatttgtcgccattgtaatgccttcacgtttgttgccgaaaagtaccttgctgcccttatgttttgaaactgttgcactgattgtcatcgcaccaggtgtcgctggcgcaatattttgtaatttaactaaaacagctggttcatttaaataattagtcccactaatccgaatccgccgtaatttcaattcaggtagtacgtggctgtcaggatgttcccgtaaaataaccccgagtgccatcgcataataattatccacactaaaaccttgttgatcggtcttttgacgactgcccgctttagtatctttaaagtatagcgcaccttttaaaacaccgttgtataatttagccggcatcgttaccttgaaattaaccgttttagtttcccgcggttttagtgtgatgacttgcggttgatcaaaaatctgactaaattgatattctgcttgtgacaaactccctggatggtacttatcaaaggcttccgtccccgaaacggttgtataacccgtattagctgaagcatcaatcgttttagtattatcttctaaattttctaacgtgaccgctaatgtttcagtttgattgggtttcatcaccaaatcaaaactcgttagtgcattatcgtattgattatcgggaatattggcactcaccgtaaacccagcacctgccccgtggacgatttgcgtattaacaaccattaatagcaatagtccaaagcctaccaataatagtagtaatctatttcttttcttcatttaaccagcatattgtgttgttggattgtcggataaaatccaagtaatggcggcgtcgtaaaccccgttttgaatatcttttaagttgcttaattctaatttagaaccagcgtctaattgacgcgctactgtgaaaagaccttcttggcttccagattctactgcttcagcagaagtcataataacattagacgccttagtgtcaattaccctattttccaagcccaacttattactatctaagagaatcttgccatctgcagtaccaccattagcacctttaaattgactcatagtagtagataaggtccaatgattaccagcaccacgatagtcactgacttgtaaggtatccacttaaccaatagctgtagcatctgcatgcataatagtgttaatatcaataccctctttactaccgaagttaaaatcaggggcagcatctaatgttagcttacctgctttaacgttaaattctgcagttgtggttgctttagcctctaacttaccttccgtatttgctgttgcctcaatacctgaacctggtgtaacatctgcggcttgtacgcctgcaacgttgatcaatgttgcgcctgccaatgtaactgctgctaataatgcgaattttgtttgtttcatatgcgaacatggcaaaagactatcattattattttaacacttatcgcaataccgattatttattttgagaaccagtactttagccatcaacaaaaagaggctcaaattaaaacaagccaaaaagcagtcttcaaagcttaccgaatccattccgaaaataattatgccaatttcgccatctacactgatacaaaatcggcaggaaaaatctactattttgtccccaaaaaccaacaaggccacgccattgacttacggcggcaacaacagcgcattggcgaacaactctatcaaaaggcacgcaagcagaaacaaaaagatattgttgtttacatcacctacaatggcgacaacttgcacgatgatacctactgcttaacaccgactggggcagtctacagccgtgtcgaacatcatttcagcactaaatttggtaaattcaccgatcaattggggcaagaagcggtttataacctcgctaaccaaacacaccccgtgacctttagagacttatatcaagatgccgctaccctaccaatgattaaacaactcgctgttgatcaacaacttaaaaaacacaactacacgccccaccaattaaaagccttggagaatcttgattttccaactgacgtcaattatcaacagttctctttttcacagcacgggttaacgctaaacttttcaaaaaacacgctgggaatcaaacagatcacattgccactagcgacaatcggtccttatctaaatcccgactatatcgctgaaggctacactatgcccagcgccaagaagaaatccaaatcagttgccctcactttcaatacagctcttgatacggaccgtaccaagcaagtccttgaaatcctcaatgaaaaagcgacacaggccacattcttccccaccggtgaagcagcccacaaacatcctaaaacactcaaaaaaataagcgcggctaatcaagcaattggtaatcaaagttacgctgccgatgatgcaatcgatacaatgagcgaagctgacttatcagcaaatcttgccaaaacagatcaagcgattttcaaagcaactggcgcactaccacgattcatgcgcgtaacccctgataccaccaataaggccattgcgagcgctagccaacgcgcattgattagttggtcggttgactcagaagattggcgcaccgatattaaggctactgatattaccaaaaacgttattgagcgcacaactggcggtgacgtcattctacttagaactgcgcctgaaacaatcaaagctttgccagctctcatcgatcaattgcaggccaaaggttatcacttagcgacaatcccatcattgtttgaacaccgtctagcacctttccaacagtacgccaaggccgctgatccttatcaagattaattaatcagtattatcgacaactttatcagccgttgataattcccaagttgcttccaacttatatttgcctgggcgtttagcacattgatctaccttgccattatggaatttcaagttaacgtcgctcttataaaacggcattgacttggccggttgtatggcgtctaactgctcatctcccgacaactgtttttgtgtatccagtgttaacaatggggtttctggtccttttaataaaccacctaaatttaaaatctggcccgcttcccaatcatcatccgtccccgttttcaacgagtacaattggacgttaaagccggtcgcatcctcttgcaacaatggattatcgacgagatccgcacctgaagtgctgttcttaacaactaatttccagtccatataaaatggattttcaacgttaatttgccccttagcaatgctgaccggttcttgttcagaggtgcctagtgtataggtcccaaaatcaaatacctttggatagttaaccaacaaatcaccatgaacattcaaggtgtaattagtaattgtattatcatactttgccttaatttcacttgccgtcatcgtcgacaaatcatcagaggcactagccacaataaacgaaaatttattcttatgcagtaaatgccaaccgataaaggccttttcgacgccattaaccacataattaccatcaatcttgccggcattataaatggtttgatcatcgtaattatcaacattatccttcgtctttaaatcttccgtgacgtcggcaatcgataattcgactgtctgagcttcactcgtcttattgggttgcaacggatttttaccgtccggctcatactttttccacttaccatcattcatccgcgaccataacacattgctggtcccagctggttgatcgattaaaaaggtgtttttaaaagcacgcccatccaaacgatgcatcgtttctgattccggatcgatttcaacgttattatttagtgaaaattggaaaacataattcgtcgtgacattttcaggactaaagttaacgccgttgggcagggtcacggacaaaatccgcggcactttggtcgttgattccaaatcagaagtccctgggaatttaccatcggcattaaagttcgccccaaacgccttatcaactgccacgttcccgtccagataaatactccgattcgtaataacattcccagcaaaactatactgagaacccccttgaataatgatgttggtatggggggctaaaatcgtcccaataaatgaataattttcttccgaaccacgattagaattcaacgtaatcgcagcgtcgtcaccaccattaatcgtattaaagttgttcatcacatgcgccgctgaattataacggaccttggtattatcggccggcgttaaatccaatcgagcattatactgtgctgttgtttgtggataatatttattatccaccggcgcattggccttaacctgtgccggtgtgtacgcccgcatactatacgttgagctggcactaaaattgaaagtcttaaaattatggaaattaaagataatatacggaatcttttgtttacccgccgtatagttcaataaattaatggaaatcccttccgctttttggaagaggccatcattagcagcaccatcaatatcaacaactgcgacaccaacatccgtacttgttgtatccatctattctgtcgccgtcaaattggcgtagtaatcactcacgttggtgacattactaatcgcttgagcttgggtactaactttattgtctttgaaatagtcaatatcccctaaataagcttttttgccattcaatcgataggcccgattcttgaaagctttcaccttattatcatcattcagaatactttttagttggctatctgggatatcatcgttagcagaagtccccatcacgtaatgccctacctctttattcttgccgaccatactatcgtctcgggcgacaatcttcgtaaaagattttgaaaaagcagtcgctgagacaagggatggatctaagttggttggtagatcaatcttcgcatccgtaaaattattaaccttcgaacttggatactcattcttatcttcagtatcgttaacagaagtcccaactaaaaaatgcccggcataaaattcgccttgcatgttctgcgtattattaccattcataaccatattttcgccggcaaagattgtcgcgtcgctggcaacccctaatggataacgttggctaggccgttcgattgttttattcccaattcgaatcaacccactgttattggtcgccgccatacttttttgtagcggcattaagcaaatcataaaactaagtactaataaaggctttaatatcgtcgttatatttattttcatatgaaagaaggcactattttgaataaattggtaaaaatattaacagtatcatcagcaacacttatggggattgtcgggctaagccaactaacacctgttcacgccgcagatacaacggctaaatcagcgggaacccttgaaattaaagacgggacacaaactttaacaagcgttgaaagtcttgattttggcgacgttgcatacgacgcaaacggcatgtcagtgcctttgaaaaagactggtgaaaaagccatcgtgaaagatacaacattttcacaagcagcttggacaatttctggtcaaacagattcaacggtcgctgatttaacaatcaatggtcaattattgtcagcaacacctgctgccgttttccataaagctgatgaagcagcattcggcgaacaaactgcaactgtcgaaaatgcgacaatggcattatctgctagtcaagcaactacgaatggtacaaaagcaatcagcatagatgttaactggacgcttacacctacaactcaaagtgctaaattcaactaaatgaaaaaatcacttcgatttttcctcccattattactagtgctcttcttcttagcccctacaaaagcttgggcggacacggctaatttttcaattgaaaaggtcgacacccccgaacaaactaaagaagctgatttctatgacattttagccaaacctaatcaaaatacgcacctcatcgctaatatcacaaacgccagcgaccaacaatcgacatacaccgttacactccgtaacagtgtcactaacaatagtggccaaatcgcctatgtgccaaatacaaaaaatactagcggccaaacactcaaccaattgagtccgaccgccgttaaggtgacggtccccgctaacagcaaaaaagatgtgacgtttcccatcaaaatgcctgcaacagcgtattccgggattattctaggcgccattcacgttgaaaaagagacagcacaacaaaaacaaacaaccaagaaaacccaaattattaatcattacgggattgaaattccggtcgtcgttcgtaccacaccttcttcaacaccagacaccaaactgcaactaaaaaaggtgactgctggtttggacacgaataaacattctgccgtactggcaaccctttataacgaaagcaattgggtcctaacgccgcttaaagtagacgctaaggtttaccgcaagtcaaaccacaaactactttacagcagccataaaaaaggcctcgagatggcccccaattcaagtttcaattatgctatcgaacctggtgatgaaccgctcaaagcaggtacttacacactagacatgacggctaaatcagataagaaaacttggcattttagcagcgagtttacaatcaaacgagcaacacccaaagaaaacgccaaaaatgaattgaaatcaccagaaaagaagaaaagtattaacatcatctggctgattgttggcttcagtatcttattactcatcctgattattctttacttgctctacaaactacgtcaaaaaacaaaagaacaataactaacgatgtttactaaggtctactttttctaatggaataacctttgttttataacgaatcttgtaataactgtacaaaatgatgaacaacggaatactcatgtaactaatcccgatcgctgtccaatcaaagtgggcaaacgcttgaatatcctggccaataatgacaatcacacagagtaagaaagcaaaaattggcccaaatgggaaccaccgtgcgtggtatttcaattctgacaattgatgaccttgcactttaaaagcgcgtcggaaacgataatgcgaaatcgcgatccctaaccaagcgatgaaaccagtcaaaccactagcagccacaaggaaaagataaatgcgagtgccaaagacactggtcataaaggtcaaagccccaataatcgttgtcccgatcaaagccatgactggaataccgcgtttgtttgtcttggcaaaaatcttagcggcatagccgtcttcggccattgaccacaacattcttgaagaagcatacatccctgaattagcagccgataacactgacgttaaaataactgcgttcataatgctggcagctgatgctaaaccagcacgtttgaagaccaaggtaaagggactaaccgcaatgttggtttcactagcacctaataatgaggggcttgtataaggaattaaacaagcgataacgaagattgataagatgtagaataataaaattcgccagaaaacttgtttgattgcctttgggatactcttttcaggcgtcttcgattccccagcggtgatcccaattaattctgtcccttggaatgagaaaccagcaacaacgaacacactcaacatcattggtaagccaccaacaaatggcgctttcttgatagtaaagttgctaaggccggtccgatgaccacccataataccaaaaatcgttaagacaccaacacctaagaaaataataactgtaataactttgattaatgcaaaccaatattcagtttcaccaaaagatttcacactcgtgatattaatcaagaaaatcaataatagcgcgactaaactaaaaatccagcccggcatatccggtaaccaaaactgcatgactaaggctgcggtactgacgtctacggctaacgtaatcgcccaattaaaccagtaattccaaccaagcgcaaaccctaatgctggatcaacaaaccgcgttgcatacgttgaaaacgaccctgaaactggcaagtaagttgccatttcacccaaactggtcatcaagaagaaaaccataatcccaatgccacaataagcaagtaacgcgccacctggacccgccttggcaattgccgacccacttgtgacgaataaacctgtaccgatactaccacccaacgcaatcatcgatagatgccgcgtctttaactcccgcttcatttcattttctgccattcaaaaatccttcgacaatagccactgacccttgttcgagttgactttaatcttaatattataacgaccagccttcagtggttggttttttaaatcaatcccgtaatcaaaattcgagttgggtgccatctgtaaatcagtttgcttgctgtgataaagcaccttactttgtccagcacggcgaatcttagcgtcgacttgcatctcaccaattgagtttgcttttgtattttgaatatttgataaaatcgcagtgtgcccgttcaacaagccaggtttaatccgatttaaccgcaaatgtggtttcacagtttgatcggattgcgttaacttaacgcctaagatataagaatagcggttcgtcaaagacgtgcccttcttatgatctaaagcttgttcaacttgatcttgcttaacttgtgagacataaaacccgcctaaaatggtaccttcaaaagtcgctttaggtgcattcaaggtaaaagttgctgtccgactactttcagcaggcaccttcaagcgttgcgctggcgacatcaatttagtaaatgggtattttaacgttttatcgtacttaggatcggattgactgtaatcaatcaccccattttgattggtaattgccgtatttggtgcgacatctacttcaaggtcttttttcccagtattttggacgacgaccgatacttcctctttttgaccaggtttcacgcccaaatcgtaatagcctaaattcttatccgtttgattttccggataaatcggtgcaactgagtaagttaccttttcggcatgaacaacctgttgattgacagtaaatgccacaaacaacgttgccagcacgcccatcactaatccaagccattttttaaagtgtgtcatttaaggggccggtgtattacctaatgtccaatcaatggtccctgtgtaatcacccgcataggccccagcattcacttttaacaatatcccttgattatcatcccacttaatcggcgtaatgtcatcatctgatgttgttgttttagaagcaattctttgagggatttcggtgacgtctgttgatttttgaccatcaacataaactagaccaccatctaactgtttgtgatctgtcgtccgtgtcaagcctgttgagctggcatataaatcccaccgcgaaccggtaccacgtgtatcagccacggttggtgcccaatcagtattatcacgtttattaatcgtatttttgccaaccgttactggcgcaaatccaatttcatttttaaccttatctaatagaagggtaccaccttttagtttaaagtagattgtcattactgtcgatttttcgttgtacccagcgttggtcatataaagcgttaatttatgggtgtcgttcaacgataaaccaaccgtcggaatcccactgactaacttaggaccgacattattttgcgcgatggtcttttctgcaccatcgtcaattgcataatgtaatgtcccaagcgcgtgactatcaatcttaccagtcgctgatgattgtgaccaagagcctgttaaagcaattggttgattcttatcaagcgcaattggtttttcctttgttgggtcagtccactttttatctaagacaagcttagggagacttgtgacgtaaacggccttttctgtcgattcacgggccatcttaccatctaaactgatttcatagttccgacctaaattggtcgtcccatcagttggggttgggtcaaaagcggttagcgtaaactgaatcttagacgtgctatttttggtaacgtcacccatattaaccccagtactaaaggtatttttccctatcgtaccaaagaagtcattttctgtcgcatcgtgcggtgtcagtgtattaccgttcaaatcaatagaaggtgttttgaaaagacccgtcgacaccttattcttcgatactaatttattattgatcatcaaatcatcggcaacataggagaccccctgagaagtatccgttccatcagtcttatagcgtacacccacttgtttccaatcagaaccactagtggggtcgttattaattgttagaaccccttttaactcttctagcggtttcgccggattgtccttcgttacttcagcaccaagggcattcccatttttatggtacactttgtaattttgtgacgtaatcggaatattcgatatttttttaaaagccacttggttcaattcgttactcttaccagttttacccgtgaaaccccagtaaacttgcgttgttccaaaaatattattgacaataattggtaccttaacggggtcttgaccatcaaatttataggtcaaagtatgatcggcataactccacttgacattaaactcatgccatttaccatctgatccaggaaattccttaacatcattatgaatcaaacgaattttagaacctattatcccgaaatctttataactactggttaaagccggataattccatgcgatatgatttctaactagtggtttactcgtacccaaaatacctgtcggtgctgaatcccaatcatcattatgtcttgtatcaaactctactgcaaaactcttcttaatagctggactaacatccacactacttgcactaccccagacacctaactgctgccctgttccgcctgtttgaattgtattgtaaccacgtggatcagcatgcatcacaaaagccatcccgtcagctgcattactgccactatccccaaagtttaagagcatcgtcgcctcaaaatccttgcttaaatcaatcctgttatccggattagaccaaatagcccccgactgatcgttggcggctggattgatgacagttacaccatcaacaggtaattcactgtcggattcctttagtggtggtgcgaataaattctcaatatttgtaatatgcgctggtactgggtcaattgctgcctttgttgggttaactaccaccaagattcctagcaataaactaatacctagcactaaaaattgtattgttttattaatacgcatttatgcttttggtgttgcggttaatgtccatgttaattgaccagtatagtcaccagcgtatgcgccagctaaaacatggagatttgaaccactaatcttgtagttccagttccctaacccttgatccttaccagctgtgataatatttttagcactatcattcgttaaatcaactgattttgtatccgctacagtgtgcgctgcgttatcagtactgataccactcgcattcttcaatgttaatgttgagttttcaagtgtgtgactgcttgcatctgtgaacggtgttgtaagcgcaacgtcaactgtataaccagcaccagtcccacgcgcatcagcaaccgaaacagtgccatcagctgtttgacccaaatctaatacagaggctgtaatttctttagtgccaaaatctaaatcaggaacagctgttaatttaaccgtatcgctacccgttaattttgcttttacgacagaagtgcctttttgaccatctgttgcgatttcatttttaggagcatctgctgcgaaagccgtttgtcctgaaatcattgctgcacctgctactgtcactaaaccgcttaataataatgtactaatcttcatttactttagatttttaataatcttttgaattaataattcacgttgttcagccgattggttccaatcaataaccggaatatcgggatgccccatcgtttcgataattaaaccggagacagtttgttttttcaattcattggcccacaacatgtccgctttatgaaaagcagcattaataatcaatgtcccttgtttagccactggttgaaaatcattaaagactgtatctaacttaccggtatctggatacgacttaatctgaccttcagttgccaagacaacatcgtaaattgatacttcactggcaggtcttgctagggtaaagccaccactattccctgaaacagattttacaagaccggccactactaacttacgaataattttccgtaagtaagtttgtgaaccacccagacgatgatgaatcacttctgacgaaatcgtatgttcaggatcttgggttgccaataacacaataatgcacgttgcttgttcaaatgctcgtgtcagttgcatctatctccttttaacaaacgtccctgaagcctcacctggggccgcttttacttcaaatccatatttagttaaaatgtgttcgactttgttgaaactctcgcgatcaaacgtactgatattgccatcgattgtttcaatttctaatttgttggctaagttacaaaaggccttaactgccaattgcgccaatcctaagttttggtaatcataaactgctaagcgtgaagctgcacccaatgtttctaaaacagtgatgtgcatttcatttttccatttgttggtttcaaacaagagttgtgcttgaaaatcaactattgaatgtccaaatttatcaacattcgcatatggtgtatacacaaaaattgagttcgttgattctcgctgaccaccttcacgatagtccgtatagacaacatactgtttaaccccatcatcgctggtttgattcatgctagataaaattgttaactttgaatctgcctcgatttgcgctaattttcttgcaaaggcttgatcattttcacttgccatttatcgaaatcctttttcgcctaaattatattggtaatattgcactaactcgccccctaaatagtcaggaagctgcgtttgataagcagtggtaaagcccactttttgtaaacaacgagctgatttttgattggtaataaaacaagccgccataaacttcgtaatatgcaggtcatcatgataagcattcataaccgcagataatgagcttgtcatcaggccctgtcgctggtattgcggcaaaatcgcaaaactgagttcgtacgattcaacagtgacatcatcttgcgctaggtttggtgccaacatcattagcccacaaaccgcatctgcctttttagacacaattgcccatgaatgttcatcagactggagcatcgtcaaaaaagattgcgcttcatgctcagattgaaacggcggcatattgagttgcttcgcaatttctttttcgcaaccaatttggtagaccactgctaaatcgctagcgataaaatgtcttaattgtacggcttctgtttgaatattcaaatggcgttacgtgattactttcatttattctcaaccgttccagaacaatcagaatcttacgattacatccttcattttctagggacgaccattccggatttgcgcgattatcccgatttaaccaaaatttgcgattgggctgcttacgacgatcacagttttagaatctggaccagtttacctttggatgaattcgaacaaaaattggcgcaattaacaccgctaaacgaaagagattaccaaattgattacagctataattttaaggatattaatttcttctaaatgttaaagcatcttgcatgtggtggtattcttcgttatcagtcctatgacgcacaacttcagataaaacttaaaaaggatgcgttaatatgtcaaaaaaatcaattagtctattcgaagcaacattagatgtcaaaaaaatcaattagtctattcgaagcaacattagttctcgtgattctcctggccattatggggaccggcgttattattttccaactttctcctcaaaccccggtcctcactgggattgccctgctgatgttatgggcgcggtggcggcattttagttggggtacgattcatgaaggaattgaggaaggtttaaaaagtggtctaattcccatcattattttcattctcgtcggtgccttgatcagtacttggattgccgctggtgtcattcccagtttaatggtttggggcttccagatggtcaatgtccactggtttattccatccattttcgtcgtttgtgccctcgtggggagtgccattgggagtgcctttaccgttatttcaacagtcgggattgcctttttcggcattggtgccacactgggattagataccacgatcgtcgcagctgccattatttccggggcaatatttggtgataaatcttcacccctctctcaatcaactaatttaacggctgccgttactgaaacagatctctttgcccacatcaaaaacttaatgtggacaaccgtaccagcttttgtcggttcattagtgctatacgcgattatcgggcatacatctcgtgatattccattgaccaaaatcagtacaacagttgccattttaaaggcccataccgacgttagtctctgggccttactacccattattttaatttttgtctgtgcgcgttttaaaatgccagccattccaacgttatttttaaacatcgccgtttcgatcggtttaatttttagccatcatccccacacttcttttaaaacaattgccaacttgattgaaaatggcttcgtcgctcatactggcaatcaaagtatcgatgcacttctcacacgtggcggtattaatagcatgttgagcacagtggccttaattatcatgacgttgaccctaggtggtctattgatgaaactcggtttaatcgaacgcgtgatggcaccccttgcaactcgcctcaaaactcctggtcaattgatcagcgcggtaattgcttctgggattggcgttaacctctttatcggtgaagaattcctttctgttatcctgccaggtaaagcttttaaatcaacgtttgaaaaatcagatcttagcaacttggcgcttggccgcgcactcgaagatggcgggaccgttattaactacttagtcccttggggcgttgccggcgttttcgccgctaacaccctcggcgtaccaacactaagctacctgccattttgtttcttcagtatcctctcaccaatcttctcaatcttgagtagttttacagggattggcctcaaaaagaaaagtgttactaattaattagaaaagattcatcaagaattgcccgccgtaaactagtgcaaagctataggctgcaattgatgctggtttgcataagatgataatccatgtgaattttttaaatgacatttcggttaagccagccattaaacataagacatcatcgggcgcaactggtaggaaaatcgctaaggcgaaaaagcgcgcaaagtttttcttttccgtaatcgtaccgatatatttatcataagttttctcgttgatgacgtggagaataaatggtttcccaaactggcgcgccagcaggaaattaaaaattgacccaatcgcaatcccgacatagttatagataaagccccataacgggccaaaaactagaacacctgcggcggtactaatcccgcccggaatcaccggaatcacaacctggataatctgaatcgtgatgaaaataatcgggccgatgagtacggagtggcccaagtacgcttgtaaggctgttgtgttgttaaaaagccctagtcgtgaccagtaaatggctaatgcaatgctcccaattagggccatcagagaagtcgtactaattaaacgtcttgaaattgttctgctcattcatcctaaaaatgtccgaaaaggttttaatccttgtgcgcgatatttttcaacaaactgagcaactgccttaggatcctgagtttgatcatcgattaccaattgttccactggcaatggccgttcgttagcaattttgacatcaatcacaactggtccttggcgtttttgagctgctgcaaaagcagccttcaattcatctaacgtccggactgtaaagccttgggcccctaatgctgttgcggcggcaccgtaatctgcaccctgaatggcaacaccagaatgtggttgtcccttgtcatcttgttctgcttcaataaagccaaatgaatcattactcaacacaacgttgataattggcatttggtatttaacttgcgtaatcaaatcttgcatcaccatcgtgaagccaccgtcaccactgattgaccaaacttgccgatcagggaaggctgcttgcgttccgattgcagctggtaaagcagcccccatcgttgcgtaccaagctgagatcgtcgtcttttgacctggtttcatcttcaagaagcggacgccatcaatcgtgacgtttcccacatctaagttgaaaatcgcgtcattggtagccatttgattgatttctttgaagactggttccactcgtaatggtgtttgtggatcatcttcaaaactagcggtccattgatcccagttagctttattagcgactgctgcacggtagaaagctgtcttttcagataccggttcactagcttcaagtaaagctgctaacgctgtcttagcatctgctaaaatgccaacgtcaacatggtgtctatgaccaagtttggttggatcaatatcgatttggatgaacttcgcgtctggtttgaagaaatattgaccaaattcgtagttactgccgacaaataaaattaaatcggccgcttctgccaaatcaacacccggtttagtggccacccgccctgctgaaaccatgtaagccgggttttcgtcagcgacgattcccttagagagggctgatgacatcattgggatacttaatttatcggataacgccactaattcatcgccggctgccttagcaccttgaccaaaataaataatgggttgtttagcttctttaattaattgtaaagtctgttgaatatccgttgaacggggttctggataattccccatctggaataggttagcagttgcttcgaagtgatcttcaattggttgccagcctaagtccgttggaattgtcacaaccgctacgccactatttttataggcttgttgaatcgcttggtcaacaactagtggtaattgttctgccgtcatcacagtccggttgtagactgctacatccgcgaacattggattttcattcatttcttggaaataatcagtattcatgacaccagttgctacttgaccaactagcgctaaaacaggaacgtgatcatacttggcatcataaagcccgttcaatagatgaactgcgccagggccagctgatccaaatgtggccgcgattttaccagtcaccttagcttcaccagaagcagcaagcgcccctacttcttcgtgacgaacttgaatataacgcataattgctttttgattatgcaatgcattcatcgttgaatcaaatgagccaccaggtaacccaaaaatatggtcaataccccagtctgccatgacttttaacattgcgtctgccgcatttatcttttgtgttaccatatggctattattgctaaagatgcacaagatgtttttaaagatgcgggcgaaaatattattttttcaacacttaatttaaatcgccaggatttctcatcagacagagctgccgtttccgatttggctgaacggatccccgcaattatcaatagtatgaacatccgctatccggatgcccatttacgcgttgcttttgggattggctcagatgcttgggactatcttttcccaaacgcccctaaacctcaagaactagaacccttccaaacgattcctagtcctaaacacgatgctgtcgctaccggcggtgatttattcttccacattcgggccaaagaaatggctgtttgttacgaagtaatggcgcaattcatgcaattcatcggtcaaaatgcaacaacgattgatgaaacccacggattccgttatttcgaaggccgctcaatcatcggctttatcgacggtacggaaaatcccgctatcgatgaaacggccgaatacgcccttatcggcgacgaagaccctgaatttatcaatggttcatacgcctttgcccaaaaatatattcattcgatggacacttggaaccacacttcaactgaagaacaagaaaaaacaatcggtcgtaaaaaattctctgatcttgaattagacgatgccgaaaaaccaacaaacgcgcacaacgttgtttcgcaagataacgaaggtggcgtcgaacataaaattgtccggatgaacgtgccttacgctaatcctggtgaaaagatgactgggacttattttatcggctacgctcgtcaatggacaatcgttaaacgcatgctcactaacatgttcgtcggcaaaccagccggcaactacgatcacctactagatttcagcgaaccaacaaccggcgcactattcttcattccatccaaaacactactagcaaaaattgcggaagaagaaatttagatgtcagatactatgcaagctgttgcgatcaaccaatacggcgatgaacaaacacttgaaatgattactttaccaatgccaaccattggcgaacaccaagtactaattaaatcaaaagcaactgctatcaacccccttgactggaaattacgtgcaggttatctcacaagcatgttcgattgggcttttccaatcgtacttggttgggatttagccggtgtcgttactgaagtcggttcagctgtaacagattggcaagtcggcgacgaagtttttgcacggccagccacttctaatcgcggtacttatgctgaatatgttgctgttgatgacgaattagtcgctcgcaaacctaagaacgtcacttttgaagaagccgctgctgtgccattggccggcgaaaccgcttggcaagcccttttcaaccacggtcacttaaaagccggtgaaacagtgctcgtccaagctggttctggtggtgttgggtcatatgccattcaattcgctaaggcaatgggcgcccacgttatcacaacaactagtgccaagaattttgatctcgttcgcgacttaggtgccgacgaaattatcgattaccgtaacgaaaaagttgctgataaagcacacaacgttgacctggtcatcgatacaatcggtgggcaaagccaagttgatgcttggtccgtgctcaatcctgaaacaggtcgccaaatttcaattgttggtgaagcacccgaaacagctgacattatcaaagacacaaagatgactttcaaagcaatctggttaattccaaatggtgaacaacttcgtgaaattgctgacctaatggctgacggtaaagtaaaatcaattattgatactgtcctcccattctcagcggaaggcttaatcaaatcacatcaactaagtgcaacacaccattcaactggtaaaatcgtcattaaattctaattaatcgtgaaagagtttatcactatcagaacccgttcgattgccaatcacaaatacttctaagatcacaaaaatcaattcgattgccgggaagaaataaatcgcaacaatcaaggccacctggatcacccagaaataaggcttcataataaccccgtaaatcggcatccctgtaatcttttgataaacctccggtgcaacttcgcggttggcatccgctagtgcgcgactcaataggaaatacatcatcaaccaagcaaaatgaaccacatagtagaaatattctgggccccgtgaattaataaaccgccccgcccaagcagtagcaacgggtaaaaatgacattgataataaccatatattgttcaaccaataaattcgtttcgtcacccgtttcgttaaactaaacatgtagtggtgattataccaagcaacccctacgaagagataggttacgatataagcgaagaagtatggtgcattttccagtaaggccttcatctcagccgtttctggtgttttaaattcaagaatcataatcgttacaataattgcaatgactgcatcgctgaaagcttccaagcgtcccttattcaaatggataaaacatacaaatcaagcgctgaattaaagcgcgaggctaaggcactctatgcgggccattggggccaagcaatcaagcttaatatcgtcccaacgctcttttcaattctcgcttttatcttaattggtggcctctttatggcactcactgcactcttcatgacatcggactttgtctcatcaggctctggctcatttcctagcaatatgtcttctggtaattcgttgaccggtaatattggtagcttcatcgttggtttaattactttggggctttcatttacgacgctcgattggctccgctcaaaagatgccgattttaacgcttttagtggtgcttttagcgtcttttcaaaacgttattttgtcggggctgtcattactgaactattagccggctttttcactgtcttatggacattgcttttcatcatccctgggctgattaagtcattttcttattctcaagcgcctttcatcttcaaagatttaacggacgctcatccagaagccgatatcaattacctcgattgcattacaaaaagtcgtgaattgatggacggtcacaaatttagattcttcatcttaaaattaagtttcctaggttgggatatcctggccggctttaccttggggattggctatatttggttaaacccttataaacaagcggcttacatgggcttttacgccgacttagtggactagttgatttcaaacacacagatcaccctagattctcaccaaaattggcaaactgttactactcagattccaacacctggcgatcacgaattactgatcaaagtccaagccgccgcagtcaatcctattgatctcaaacggcgcgccgttacaacgcatattttaggctacgatggttacggcgaagtcctagcaattggcaaagccgtcacgcaatttaaagttggtgatatcgtctattacgccggttctactcagctagatggcagttttcaagcctaccaatgtatgaccgaagctctctgcgcactcgcccccgaccaattatcagcgagtgaagcggctggcctgccgctagtctcactaactgcctacgaactactttttgaaaaatttcatttcaaggccgcagaacaagcccacctcggtaaaaaccttttgattattaacggtgctggtggggtcggctcaattatgagtcaactcgccaaatgggctggtttcaccgtttatgccactagcagtcctcaaaattttaactggctaaaagccaatggcgtcgattatcctgttgattaccaccaaacaagtgaccagcttaacatcgatcaactgccagcagaacacttcgacgcgattgccgttctttacgatgttgcaccctatttatctgccgcaacacgcttaatcaaaccactcggtcatgtcggctcgctggttaatatgcaagccccacttgatttaaccccactgaaagcaaaatcagtctcatttgattgggaatacatgtttactaaaacggattttgattacgagattgccagccaaggcgcaatcctcaaaaaaatagcgcgcctcgccgacactaatcaaattcactcgattacgacgcaagtctaccaaggcttatcggttgaaaacctcgacacaatcaccaaccagctatcaggtggtcattcagttggaaaacaaactattatttattaattaatgaccttgtatttgacctaactcgcttctaatctggcccacagctagattaaagcttgtatgatcaacctgattagaaatgctagcaccctttttttctaaagaaactaattttgcctgaatcgctagaagcgtcttttgcctatctgttgccaagccactaaaatcagatggatattgactacccagactcacaagtttttcaagttgcggttctaatttttttacttctttttcatagcgcgctaattgttgcttttcctgtgcccgactacgcccttgtgtaacttgcggcgctggtgtacttaatcccggagtgatgccattggcgctgactccccagataaacaggcccacattgataatggcaattaccaaactaatccgcgctagaattaatctaaattgccactgtttagcagttagacgtaccaaattaggccgttctttgtaaaaatcacgcgctaactttgttgttgtaaaacgaaattgcttctgtaaaagcccccaaataaagcactgatgaacaccgattaatagtaaacaaagaccggcataaatagcggtaacctccgtaatcatcggcttaataacaagcgccccgacagttagacaaaataacgcaaagactgctaacagcgtacataagtacccccgataaagccattcatacttgggcacatttaccttcaatagctctagctcttctagacttaatattgatttctcatatttagaaagtcgctttaattcacgacgccttgttctttcagttactaacaaaatatagcgtacgaaaaatggtgctaataccattagcataaagacagtcagtaacaaccaacctgtcatttagtggttcaataagccatatttaattttaaaacgttgaataatccggtaccacgattggtaaaaacaatagataaagaacacgttcgatagtgcgtgggctagatcgaaataaaaactcgcaatataggctgcgatgaatgttttgagcgataagggattaacataggcgataaaataccataagttcattacccacccgaaaataaaaccccaaataaagccgaataggcaaagccaatatttattgtgggcccaatcaaagcggctaatcagcccggctgtcacgcccatcatcccccaacaaaacatctgccacggtgtccacggcccttgacctaagaagaaattcgaaaccaaggccgccgttgaaccaatcatgaagccagcttccggacccaaaaccaaagctgcgacaatcaccacgaaacttgttggttgaacactcggtagcggcgcaaaagggacccgactgaccgccgcaatcgtcgctaaaacggcaatcatcacaatttcacgggcccgaatttgacgtttttcaaagcgccaataaaatggcagcatactgaccactaaacaaatgaaactcaatgctaaaaaatactgtccctgtaattgaatgattaagcctaataaaaccgcaattattaaaaaggcactcccaaaaacaagactactttgccagtcaatgcgcttcattcatcggccaacctcttcccaagttaacgccgcagagtcttgtggtcgtaagagtcgattaatcggggtggtgtaaaagaagttcgattggaagaattggtgcggtgcttcttgcgcaacaatcgcgccatcaaataacaaagcacattgattcgcaaagcgagcgctaaagaccatatcatgactagccatgataatcgttaatccttctgcttgtaactgctgtaataggcgtccaagtgcttgtttgcgcagtggatctaagccttttgtcggttcatctaaaatcagcaacttcggattagctaataaaataatccctagcgcaatcaattgttgttcaccaccactagtatcttgcggatcactgtcttctaaatcagttaggcctaacttagccagcatcgctgtggccgcttcttctggatgttcacgtcctaattgaacggcacgccgctcaaattcaatccggatactctccgcactaaactgatcagctggttgttgagacaaataaccaatcactttaaataactgctctgtcggccacttttgtagcggtcgttccaacaagcggacagtcccgcgacggggttccaacaaaccaatcaatacttttaaaagtgtcgacttaccaatcccatttttaccgacaatcgctaaccaatcacccgtatggaccgttaatttgagctgattcaaaacatacggatcatttttggtatattgaaaatctaaatggtcagctgttaataatgtttcttgcgtcccggctactaccggacgtaattgatcatgaatgttgccggctggcaattgacgttgcccggccacgaccgttagtggcactagttcagtctcagtggttagttgttgttgccaaaaaagccgcggaatctccggcatgaaatcccgtaaagttggttgctgccaaattgcctgtaaaccttgatcaactggtccttgataactgaggcagccgtttgtcattaaccacagtttattagctagtggtaacacatcatccaactgatgctcactcatgataatcgttatgcccaattcatcatgcacgcgttgtaataagctcataaactctttggtcgcaatcggatctaattgggcagtcggttcatctaacaccaataggctcggttggagaatcaaaattgctgccagattaaccagttgcttttgcccgccagataattcatggaccgatgcgtataaaatatcctgaatgccaagaaaactaacgagttctgcaattctcttttgaatattggcgctagcttcgccgctattttccagtgaaaaggccaactcctgaatcacggtatccattacgagttggttctcgggattttggaaaacaaagccgattttctgtgcactaacagctgggtcgagatccgccaatagttgtccattgaacgatacctgtcccaaacgctgtcccaccggccataattcccgtttaaattgacgcaataaggttgttttaccactacctgaaggaccggccacaaccacccaatcaccagcattaaccgtcagattaatctcggccaagctcggctgatttgctaatgcatattgaaattgaagctgttctatctgtgcaattgccaccatctatctgtgcaattgccaccataagtactcccatccttccaataataatggtaacccatcaatcagcaaaatcacgcttagacacaccccatcacggctggttaaccgcaatgtacctagtgtcggataaacgattaactgcccgttaccctggctggcgcaccaaaaggcgaataggccaccgctaatgagcgccatcaataggccataatcgcgatgcgtcatttgataatggcgatacgtacttcttttttgaacaccaaagccgcgggccgtcattgaatcggcggtctgcagtgcttcagtcagtgtattggttaataaaattgccaacagatgcatccctgcttgggcgcgattttttagccgccccgttgccatttgaatccctcgcgttcgttgcaccgccgtaatatcgcgtaaacgccgaatgaataatggaaaaaagcgcatcgtcatcatcgtcagtaacgtcaattgcggggcgattccgccaaataacgccaaaaatttatgattggtcatatgctgattataagtcacaaaaatcaataataaaacggccaaagcggtcgccattaaaaaaccatagaccaccgcttccgccgttatcagggtaccgccaaccgtcatcataacgtgcgtcccgtgattattgataattggattcatgatgacaatcaggaccatcatcaataaggcaccttgcagcgtgctaactgttttctgttgatttttggcgacccaattaaccgcaataataacgatcagttggccacataaaaagtaggggtggttgaaacacatcgaaaaactaatcattaatatgaagtacaccaataaaaccagtgggtgtaattgatcaataatcagttgcgattttagccctgaggcgcgtggcgatcgtgtccgagatcttccgtatacagccaattagccctgaggcgcgtggcgatcgtgtccgagatcttccgtatacagccaatcaataacatctccactcttcacatgatagacaccacacgattgatttgaaaaaacgccgttgacccgatagagccaaccactctgggggcccttatcgaattcaaacaagccattaatccctttgacataggcgctagcaccaatcccacggtaagatagcggcatgccttgttggcccgttagccgttttaaaacggccagcactgtctcaccatcatcaatcgttaccgaagcatgattaattagggctgcattgccttcactaatcggcccgtaaacacttaacgttaccttcttggcagctggttcaggttgtttggctggtgcttcgtgagactcagcctgctgtgttgattgttgcgctgttgaaactaccgcgctgcttgctgattgacgtgttgttgttggtggtgtagtagtcgttgctgactgtgaggttggcgtttgtttagctgacgcgcttgcctgttgttcttttttagcaacactggcttgttcagactgactaacctgcttggcttctttagattgtgcctgcttagaagcgacagaatgcttcgtctctttagccttagtcttagtagtcgtcttttttgaagtcgattcggcgtgcttggtgaccgccttgtgcgcaactttttttgattgcgtcgattgctcacttgcatgtttaactgtggttggttgctgttgaacactcgcataggtctcgtagccgattccgcctagtaacacgagacttgcaacgcttagtagtaggcgctttttaaccatctagcgttgttttaaacgacgtgtttggtaacctgcaacaccaagtaacatgaataacccagctaaaacactaccccaaacagattgatgacccgtttgtggtaaagcatcttgcgtcgcagttgtgccagtcaatggcatcccatcttctttataccccggttgtttgggcaatgttttatctaaatcaacttctgaagatgatgatgctgacgattcaccggctggctttttgccaggaatacttggctttggatctggcgctggctttggatccggttttggctctgggtccggttctggcaccacttttttaaagttatagattgagcctttgcccttcaataaataatcatactggcctaaagcatagaccgcttgttccgttgacattgacagtgcgccatcatcgctacccatcatccagcggaattgcccgtcggctttttggtaagcaattaagttcgtgattggtgtcgcaccattatcaccaacaaaagttgtggctggattgacgccagctgcggccaatcctaagatggccattgccgtactatttgagttttcttcggttgaaaaaccaccaggaatcaagaaaccgcccgttgctttcacaaaaccagttgtttttaataaggcaactgcgcgatccaaagcgctttgaaccttaggttgatcacgatgcatgcctaatgctgacatcgtcatccccgtaatatccaaatcactgactgatccgaaaaaggcccaaccaccagctgtgttttgttgttttaaaactaaatcgattaattgattaatcgtttggtttgcttgtgaaccgtaatcttgagtgctaagggcaataatcccatagacttgtcctgtgataccggcagtagccgcttttttaataatttcagcaattaaattaacgccgttgaattgtgttgggtcttcgccaattgcagcgatcccaattgtcaggcgttccaagtcggttgcagaataatgaccggccattccggttaattcttcagcaaagacttggtggaacgttgctttttgggcggttgttaattgcgccccagaactgatccgggccaaagccgcccaaacttcagtatcctggctagttgttaattgttgcgccccacgcgccatagccccttgatagtcctgatttaaaacagctttagcggctgattttacaggttgattattggttgtctgggctgttttagcaggtacttctgccacttgtgaacatgaagacgtcccttgactctgacggcttgattcaaccaattgatcactggcaacttgactgctagttgattgactagcactgagttgacttgtcgcaactgattgctgaccggtttgaatatctgtcgcatgcgcactcgtcgtactcgtgacagctggtgctaataataataaactcgcccataatccggtatagatttgttttcgtttcatttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacaacgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatgaactttttcaaacgtgcttggcaaaatatttcattcaaaaaaggccgtagcttattattagtcattgttatgactgttattctagtcttcattatggccgggttactcattagaaacgccgcagtaacaacggttaacaacaccaaacaacaagtcggtgccagtgtcaccttatcggccaaccgtgatcaggccttcaagaaaatgcgctcgtcgacaccaccaacgagcacttctaaaacgaagaaaccatcgctcagcatgccttcggttagcttagccaacgtcaaaaagattgcggcattatccggtgtcgcaaactataacgttagcgttgcaacttctgctaacgcttcttccattgatgcgattagcacctcttcagctagcaacaatggtccgatgggcatgtcacaatcaacctcatcaggcgatttacaaatcactggtgtcctcaatatgaagaccctcagcgatttcaaagataacactaacaagattacaaaaggccgtgctttaaccagtgccgatgttaatactaacaatgttgtgattgaaagtgaacttgctaaacaaaacgatctcagtgttggcgatacaattaagattaaagccacaacgactggtaaaaaagcttataccctcaaagtcgtcggaatctacaaagcgagtcaaagtagcagctcaagtatgggtcctcaacaaagcgatccttctaatacgctttataccgcttatacattggctaaccaaattaaaggccaaaccaataaagtcgacagtgccgtctttactttaagcaatccaactcaaaaaacggccttcttgaaagccgctaagaaaattatcaatactaagaaatttagtctcacagcagacgatagtacttaccaagccttgaaacaatctatgcaaaaaatggaaagtttcgctaataagattgtctggttagttgccatcgccggtactgtcattttagcgctaatcatcatcttgatggtgcgcgaacgccgttatgaaatgggtgttttactctcattaggtgaaaaacggactaaaattattgggcaattactcgttgaaatgttcatgttactaattgtcagcttagcactcgcgggtatcggtggccaatttgccggtcaagcgctcagcaagcaagtcatgagctccgttacaacaagtaccacaaccgacagtgcaacaactcaacctggcggtaatggtggccctggcggcggtcaagcaccaagtggccaacctggtggcaatcgtcctggtggtcaaatgacgcaaggaacgcaaaataaagccaaatcaattaaagcgagcgatctgaaccttaaaattaatccgttaaccttacttcaattaggcgcctttggctttacaatcattgcttttgcagtcttactcgcttcagccaatattttaagactcgaaccacgaaaaattctcattggataaatgttaacagccaaagatgtcagttattggtacgattcagaagaaaatacactctataaagacgttaatctcaactttgaagccgggcaactctacggcattatcggtagtagtggtgccggtaaaacaaccctcttaacaatgcttgccggtctcgacaaaccacgcaagggtgaaatcctctatgaaggcacttcacttcaaaaaatcggtttgacgcaataccgcaaccgctatgtttcaattgtcttccaagcctacaatttactcccctacatgtcggcactcgataacgtcctaaccgcaatggccattactcattcagaacgcgaaaaccctagtgagtttgcgctagagatgctgactaaggttggtatcaaccctgatatggctcgtaaaaacgttcagaaactatccggtgggcagcaacaacgggtcgcaatcgttcgtgcaatgtgttgtgatgcaccagtcgttgttgccgatgaaccaaccgggaatttggacgacactaacacccgggaaataattaaactgttccaagaactcgcccacgaacaacaaaagtgtgttattctcgtgacccatgaaaaagaagtcgccgcgagttgcgacgtacaatatctattgcagcacaaaacttttgaagaagtcacactctagatggccacaatctattacgattatttaatgcaggacgatcaaaaaatagtcgttgctgcaaccgatcacggcatctgctttgtcggttcacctaaccaaccactcagcgaactaacaacttttatgcccaatcacgacttattacaagaccccgccaaactggcgccagtgattgaccaaataacggcctatttaacgcacaagagaaccacttgggatttgccactcgacttcttagtgggcacgccttttcaacaacaagtctggacggccttgcagacgatcccctatggtcaaaccgtgacttacaatcaactcgccacacaaatcggtcggccaactgcgattcgagcagtggcctccgctgttgggcgtaatccgctcctcatgattgtcccgtgtcatcgtgtcatccgcaaagatggctcactaggcggttatcgcggtggtttgcctttcaaaaaacagttattagccctcgaacaataattaacgttcttcgctacctaataaacgacctgtaaaggctgctaggatagcacccacgattggggctgctaagtaaacccaataatgggctagtgctgaaccgccagcaaaaatagctggtccaaaacttctagcagggttcaatgacccacccgttaagttgagcgcaacgataatcaataaactcaatgtaatcccgattgccaatggtgccatttggctattgccaaaacgatcactggttgtcattaagattaccaagatgaaactgaatgttacgatcacttcaactaaaaaagccactcctgcgccaattttagggaagtctgtttgaccaaaaccagtccggcttaaatcaagcgcattgatgagaactgatagtaaacctgaagccacaattgcgcctaagaattgcgctacgatataaaaaacgccatcttttgcttctaagcgtttattaatcatcattgcaattgacacggctgggttaaaatgaccacccgaaacaccaccaaaagcataagccatcacagtgactgttaacccgaatgccaagccaattgttaatgtatcagctttagcaatcacgactgcgccagtgcctaagaacactaacataaaagtaccaataaattctgctgcataacgtcgcatttactcagcaactaaaatatccaagaataattcaccatatttttctaatttattctccccgacacctttaacatctaacatttcagtcagtgaggttggcataatttcacacattgaatacaacgtcttatctgagaagattacaaatggtggtacaccctgttcttcagctaaatcacggcgtaattcgcgtaagcgttcgaataactcattatcttcaggcaatgttttttgaaccttagcagccattttacgcgacactttttcttgacccttaagtactttgacgcccgccaacgtgatctgtaaaacgggatattgaccaccagaagcccgtaaatagcctgatgcgactaaataatcaatcaaaccactgacttctttttgtgaatcgccccgcatcaaaccgtatgttggcaattcatcaaagcggaactgcataatcttctgattcttagagcccgtcaagacttgcgcgaccattactttgccgaaacgttcatccattcgcttgatgcacgataaaaccttttgaacatcaattgtaatgtcttgtgattcgcgtgtatcaagacaattgctacaacggccacatttttcacagtcatcatcaaaataattgacgatatattgttgcaagcactgttgcgtgttggcgtattgtgtcatttcttgtaacttagcgtattcccgttgcttattttcatcgtccatctctgattgatcgatgaaaaaatgttggatttggacatcattgactttaaacagtaagatggcctcacttggtaagccatcacggccagcccgacctgcttcttgataataagcttctaagctgccgggaatttgggcatgcacgacaaaccgcacattactcttatcaatccccatcccaaaagcattcgtggcgaccataatcggtttacgatcgtagagaaaatcctcttggttttgccgacgcaccatttcatttaaaccaccatgatacatcgtgactgccagtttcgctttttcaatcagcttcgtgagccgttcaacttctttccgagtactagcataaatgatgcccgatttttgctggttaactttcaaataatcgattaagtagcgatcactgttttgatttttaaccacttgaaaggccaggttttcccgtgaaaaaccagtcttaacttcatgttgaatccctaagcgcaacataatatcatcagctacttgtgatgtagcagtcgccgttagtgcgacaattgttggttgttgtcgcatgcttttaattgtatccgtcaagcgtagataactaggtcgaaaatcgtgcccccattgcgagatacaatgcgcttcatcgacggcaatcaaatcaatcgttaattcggctaaatccgctaaaaagtaatcagaatccaaccgttctggcgacacataaagcaatttgacttcaccacgtgcggcctgattgaagcgctcctgcacctcaccttgcgtcaaggtactattgataaacgttgccggaatcccattttcgttgagcgcgtcgacttgatctttcatcagcgaaatcaatggtgaaacgactagcgttaaccccggtaacatcagcgctggaatctggtaacataacgacttcccgccaccagtcggcataatcgccaatacattggtccctgctagcaaggattcaatcacatctgcttggccttctctaaaatgatcatagccaaatttttcttttagtactgcttgtgcctgcatttacactgtaattctgcctcttaatcccactactgcccaaatcataatatttaatgagagaccgataaacggaaatggtgggtaaaaaaagctgacgatcaacgtgataaagttcaaactaaatgaaacaagttcgccaattaacaacatatgcatattgtgaattgggttcgttttgatgaccaatcgtcttagataagcggtcgtgatattgaatagtaagacattcacgttatataacgttgaggcagctactgaatgaatatccgtccccaaccaagccgttgttgctggcaataatgatgtccagaatagtaataagatattcacccagataatctggccattaatttgcttcacttgcgcaaacaaataatgatgattaacccacattgtcgcaataaaaataaaggttaatacatatgcaaagaatttcatccggacatctaaaatcgccatccatgaatgatcgtcctctgggagatgtagttccaatactaaaattgttaaaataatggcaattaccgcatcagtaaatgcttcaaatcgttcctttttcatttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaaatgattaaactgcaagttaacttaaaggccacgcaaactgagattctttttgaccaacaaatgctaaccatctattcggaacaaccggccacattaccaccgtttgacggcctactactgcatacaaaccagcaacaaatcacgcaaattgactatctcgctggggaaatcacgaccattccaaacggaccctttttaacactcactgatacggactggcccgaaggtctagcctatttaggctgtttgttagccgaacaatcatcagccatcaaaacaaccgatttaccggccaaagtccccagtaattaccgccaaactttacgaccactatttgaaacgttaaacttaattctagaaagatttggtttcaattggcaaccagcggcgaacccaaaagtaaaaccagctgctaaggcccggcaccgttggacaaaagccatcagcccgtaccatttaacattaaaacgcgacaagcaaccggcactgccatttggcaaaaacgaaacgaaatgtgcctgaatgccggaaccgccgctcaacaaggatggctcactcggatttgccgctaaaatgggcacccaattgcgccacgaacacagcaatcaagttcaagataatgtcacaacagaagatattattttcaaaagtgtcaatgaagttggactttttctctactttgggggcaccaatagttggctagaactcattgatcaagatggccgctcaattgatgactggtcaaaaatttaaatgcaattaacaagtacagggattcataatggttattttgatgatatttatggtggctacagtgatgcactaaacgaaattggtatgcccacctattcaattccttttataattgagcaagcacccgcagacactgttacctatgcggcgattttctatgatttagatgcctatgaagtcaccaaagggttcccctggattcattggaccctcgccaatctaaaagcaacaacggtcttggcaaatagtagtcaacaatcccccgcttttgtgcaaggcgtcaatacgtggcacagcccgatgacggataaccaagcagcggaagcctctgcttgctacggtggtatgacaccgcctaatcgcgatcacacctatactttgacagtttttgcactcgattgttcacttgatttagaggacggcttttacctcaatcagttaacaaccgccatgaagggccacatccttgataatgccgttctggaagcaaaataccgtcaatttaagcactaattgaaaaagaaaatgattagtctggtcgcgattgttgcgctcatcatcgtcggattttccggttataactactataaaaatacttaccagggtgacgttggctacgcccaagtgcccgctaaaacgcctaccaagcaagcgacaaaggacgatcaaggtaaggttgtgccaaatgaatacagttaccattaccaactaaatgttgttaaagaagatggtacgcgaacaactgtccctgttgaaatttctagcgaaaaaccaacaccattgacacctaacagctacgtcaaattggaattcaattcaaaacgagttttatccggccctaataatatcgccaaagataaagtcccagctaaagtacaaactgaattagaaaaataattagtgaatgaattcaatactattctgaacactggcaaaattagttaacgccgcgagaaatgctgtttgaacgtgcgacgctgatactgattcaccattcatcattaacgttttggtagccgttgcatcctgaattagaattggttgatagcctcgttcaaaactcgcacgagtcgttgagtcgatacacatctgcgtcatcatgccgcaaatcacaagttgatcgattgctaattcttgcagcgcggttgccaatcgtgtttcttgaaaactgttcggaaaatgtttttcaattatgatagactcatctgtaacgtgtaaatcaggatgtaactgggcgccaatcgtcctttcttcaaaaaaatcggcatctttttgacgtttgatatgttgaatataaataatcggtaagtgtttagcttgaaaatcagcttccaagcgtttcactgcggccaaagctgcttcagggtgtgataaggccattttaccacccgggaaataatcattctgaacatcaattaccaacaatgcttgtttcatatggaccaactcaatctcaccattttaagcctactcaaacaagatagccgcctttctaacaaagaaattggcgcccaagtccatctcactgggcaggcagttggtcaacggattaatcacctaatcgaccaacagaccattacccgcttcacgattgaaatcgcacaacagcaacggcagttcatccgactctttatgaataataatcatttttcagacgtcgaagcagcggtaaatcagtattctgaagtagactctttttaccaagtcagcggccaagcttgttatgtggtcatcgcacactttgaacaaacgcgcctgaaaactttcatcgatcatctttcaaattgggcccgttatagcgttgaagtggttttaaatgacaaaaagagcaactaattagtgtcctcggtgttttatacgtttcttaacttgacgctgtcgaaatttttgctttttagactgctgctttttctctcgtaaattccgacgcttttcttgtttaattgtttgatactgttgctttaaaagttgctgtgactttgtaccaattccagccgtcatcgcttgtttagccattcgctgttgtcgtttcggatttatctgataatgttggcacgccccttcgctttcaactgtataaaattctaattctgaaaaatgccttagaatatattgataaacagctgttgccttaggcgcactactaccaaaattaaccttggccacttgatatgaagtatcagtttgacacgtaaaaacgccttgataataaggtgcctcaaaaacaattgttaaactaccgctaataaataccacttagagttgttttaacgcttcgcgttgcgctaatgccgataacgtatgtgtgtcgacaaaatcaattacccattccggattagtcttagcgtaatcacgcaaggcccacccaatcgctttttggatgaaaaattctggcgttgtttgatcgtcttcgatagcagcttgcaaatagtcaatacatgttgcgtccttgaaccctaattgcagaatcaacccgacgcggcgtaaccaaaaattctctttttgagcaaatagttgcccgacccattcaaattcagctggatgacgcttgatgtactcgctaaaaacacgtttccaagggtctacactgtcccaccatgctttttcagttactaattcggcaaactgcaatagatctgcacgttgccatttgcgcacggcccgcgccgcaatatcgattgcgacatattgatattcgcgcgcttcacgcgcataaagtgccttaataatgaccatcagttctgccgctggtaactgtttcacagctggccaaaagtcgcgttcataagcatgtctttcggtcgctttgacaccgttaaaagtgaactgatcttgcatatatcgcgccatcgctgcttggttttctggatgaatgggtaactcgaatatcaacatcatctacactgttttattccaaaggaccttttcatacggttggccgtggccctctaagatcgataggcttgcgtttgccaccattttctgatcgcgaatggcactaaacggcacgcctaaaagggttcccatgacaaacaataaaacaatcccgtgcgccacaattaagacgttgccctctggataagcttgttgggcttggtcaataaccgtcatggcccggtctaaaacggcttggtaggattccgcgtgaatctgatcagcctcaaataaatctggatggtgaaagtagttatcaaattgcggatgcttttcttgtgccgctaccggctgtgcttcccaatcacctagcgccatttcccgtagttggggggcaatcgttaacgccggttgcacaacgcgcgattgcgccagtaagtgttccgcggtcgtctgggcgcgttggagcggtgacgtcaaaatggcatcaaaaatttggtcgcctagataatcacccaagcggtctgcggccgctagccccgctggtgtcaacgcagaatcgaccccaccgccattgaaacactgtgctttattaatggttgtttcgccgtgacgtacaaaataaaaagttgtcatgttcatccccacttatttaatattgacgtaagtcaaatcaaacaagtgacttaaatcttgtaattgttctgaatcaacagcaaatgataagactgtatggtgaccaccaccaacggttaaccaaccaacggcaccttcgcgtaagccttgttttggtgtccagagttgtttagcaactggcaagtgtggtgtatcagcttctggtttgttgccgcgaacatcatatgacatcaatttgaattcgtcgccataatcagccattgtgacgtccacagcatcgccttgcatccctgtgaagactaaacgtgcaggatcgtctttatcgccgatatctaatgggtgcacttcaacccgtggtttatctgacgcgattgaaggatcaacttcaagcatatgtgaccccaagatagcttcgtggccttgacgtaaatcaagtgtgtaatcttccatgaagaccgtcttttcattatgagccataatcttcaacaagcggtctaaagcagctgtcttccagtccccttcgccagcgaagccataaccttcagccatcaataattgggctgctaaaccaggtaattgttccaaaccaactaaatcttcgaagttggttgtgaaggctgtgtagccacgatcgtccataaatttcttcaaaccgaagtattcacgaatttggtatttaacattgtgttcgaatttttctggtgtattttgaccttcaacaaagtcgtattctttttgtaaatcagcatacttagcgtcgatatcagcctctgagacagcattgacttctgcgactaaatcaccgacaccccaataatcaaccgtccagccaaacttgatttgagcttcgactttatcaccgtctgtgacggccacgttccgcattttatcagcaaatgtcacgactttaatcttgaatgattcgttgtaagccaccgcaacgtccatccatttagccattgctttttgaacgtcttcatcgccccagtaacctgagataatcttgttatttttacgtaaacgcgcattgatgaaggcatattcgcgatcgccatgagctgattggtttaagttcatgtaatcgaaatcgattgtgtcgtatggaattttgtttaagaattgagttgctaaatgaagtaatggtttttgtaataattttgtcccacggatccagtttttagcaggtgagaaagtatgcatccaagtaatcacaccagcaacgtgatcgttgtagttagcttctttcatcactttcgtaatgttatcagcagttgttgcgactaatttgaaaacgattgggtaaggtaattggtgactcgcgtttaatttttcaacgatttccttagcatctttttcaactgagcggagggtttcttcgccgtataatgattgactccctgtgacaaaccaaaattcataattttctgtgtttaacattcaacgcacttcttttttagcatgaccttgtgattgggcgttgttttgaccgtagtaggcatttttgccatgcttgcggtaatagtgtttgtccaacaagaattgtggtacggcactgttattgcgtgtcaattgaagggcgtgataatccatttcggccaccacttctaagactttagcgttataaacggctttgtctggtgtggcaccccaagtgaaaggtccgtgttggcgaacaaggaccgctggaacggcttcagggtcaatgccttgttccttgaaggttttcacgatgaccttgcccgtattttcttcgtaatcattttcgatttcggcctgtgttaaagcttcagaaactgggacatccccgtaaaaagtatccgcgtgtgtcgtgccaagtgcgggcaccggaataccggcttcggcaaatgaaacggcccaaggtgaatgcgtatgcacaatgccaccgatttctggaaattcattgtataaaacggtatgcgttggcgtatcactagaaggattcatattgccttcaacgacttcgccttttaagttcacgacaatcatgtcgcttggttttaagtcttcgtaatcaacaccagaaggtttgatgacaaacaagcctttttcgcggtcaattccggaaacattgccccaagtaaaagtgactaggtctaatttaggtaggcgcatattggcgtcatacacttcttgttttagtttttctaacattcacttctcatctttaatcgcagcaattgccgcactttcaattggtaaccctgcttggtaggcctcaataaaggtttgataaccagccacacccgcggcttctggactgagcgtcatgctttctggattcgtaaagacgttgtgatccaagaaatcatcgagcgtttgaccattattatcagcggcaaacattgctaagacagccatgccccaaggaccaccctcgccggcattactcataaccgtaatcggcgtatttaaagcgttcgctaagacctgttgcccaacgacgggggttttgaacaacccaccttgagcaatcatgacgtccgtcttgatttgttcttccttcaccaagatatccatcccaattttaagcggtgcaaaggctgcatataattgggtttgaataaagttaggtaagttgaagtggctatgcggttgtctgacaaataatgggcgaccagccggcattttagtgacattttcaccggataagtagctgtaattaatcaaaccacctgcgtcttgatcggcatgggttgcttctaagaacaacgtttcgtataaccgatcaggcgctaatgagacgcccaagcgtgctgcaaattcattgaataaattagcccaagcattgatatctgacgaacaattatttgtgtggaccatcgcaactggtgagccatcaggggtcatcaccatatcaatatcgcgatgcacttgtttgagcggttggtctaacaccaccattgaaaaggctgacgtcccgactgagatgttcccagtccgtttgcggacgctgttagtgccgaccattccggttccggcatccccttcaggtggtgccatcaagctacccgctgtcaaattaccgcttggatctaacaattgcgcgccggctgacgttaattggccagcagcgtgtcccgctggcaagaccgctggtaaaatatcggctaactgccaaggttgttgttgaacgcgtttgatttgatcgaattgtgcgactaactgagcatcataactacccgtttggggatcaattgggaagacaccggatgcgtcgccaatcccgaggactttttcacctgataattgccagtggacataacccgctaaggtggtcatgaaagccacttggctgacgtgtgcttcgtcatttaagatggcttgatataaatgagcaatgctccaccgttgtggaatattaaaattaaattgttcggttaatttatcagccgcttgttcggtaatgttgttgcgccacgttctaaaaggcaccaacaattgatcgtccttagaaaaggcgagataaccatgcatcatcgcgctgacaccgatacttttaatcgtggtaatcggttcgtgatacttactttggacttccgcagccatttgcatatagctcgcttgaatcccggtccaaaccgcatcaattggatatgtccagacaccatcttctaattggttttcccaaacataactccctgacgcaatggtttgaaaatcttgcgctactaaaacggctttaatccgtgtggagcctaattcgatccctaatgagacctgaccggatttgatggcttgtgctgcctcaattaaattcatttatgctttatgcgccttgtttgtgccttgcgcttcaatttcttctaatgtgtgacccattgtttcagggacacaagttctaatgaagaggacacccagtaaacaaatgacaccgaaaatggcgaagaccccttcttgtggcatggatgcgatcatcattgggaagagtaacccaactaagaatgagccaatccagttgaatgatgaggctaagccagatgctttaccccgaatagctagtgggaagatttcaccgactaaaacccatgtcagtggtgcccaagtaaaggcgtaaaaggccacatagagacataagaaaacgacaatcatcattgggttaaagttgggaatcagtgcattcatgatggctggtaaaataaatgacaagcccatcacggtcccaccaagtgttaacaacgtccgccgtttaaacttatcggcgatgactaagaataaaagtgaacctaaaactaagatgaccccttgaataatcggccacatcagtgctgaactagcggctttgcccgttgccttttccacaatcaatggaatgtagtagaaaatggcattagcgccttggaattgttgaaatccagcaaccccaatccccgcaatcacgagatatcgatatttaccacttaaaagcgttttcattgaggtgctttgttgcacgttactttccataccggccgtcgtctggatattcgttaattcagtttcgacctcgtcttttgaacggatataaccaaggacttgccgtgcttcatctaatcgattgtgtttcaccaagaaccgtggggattctggtaaccgtaaaaccccgaaatacaaaataatggctggtactgcggcaaggcctaacattaagcgccatgctaattgttcaggcaaaccttttaataaataatccacaatgtaagataacaacatccctgaaacaatcatcgtttgattaatcccagtgagtcggcctcttagtctagctggtgccatttcagacatatatgccggtactaacgcggatgctgccccgactgctaatcctaagaaaacacggacggcgattaagtagacctgtccgtcgtttggcgagaatgctgatagtaatgagccaattgcaaaaatcaaagatgataacaaaatcatcttccgacgaccccatttatctgatagctgcccagctagtgcgccaccgaaaatggcaccaaacattactgccgatgtaatccagccaacaacccctgcattattctctaaatgccagtcgtgttgtagaaagggtaacgcccccgtcattacgccaatatcgtaaccaaacaagatcccaccaaatgagccaaagaagtaaataaagctacttggaatttttttagcctgcgtcatttatttaacttttccggcagagtcccgtttaattaatggtggttggtatagaatcgattcaaccggtttatcctgaatcatgtctaagaccatttggcctgcatcctcacccatcttggtcttattatggttgagtgttgtcagactaggactaatataccgtgacatttgataatcatcaaaaccaacgactgaaatatccgccggtacttttaagccttttgatttcagaaaatcaatcacccgaattgcgagttgatcattgtaacaaacaattgccgtcggtacttctgaaccttgtaaataatccgccacacgtttcaatactttctcgaaactgtcgcctgattgatacataattaaattactcttatacgcaattgcaggttgttgttggtaagcttgaataaagccattcatccggtgaacgccttgcagatccccaacttggaaaatacctaaaatcgcttcatgaccgagttcaaagaggtaattaaccatctctttttccgcttctaaatcatcatttgtaatgacgggaaaatccaattctgggtaagaagcattgataaagagcgttggaatttgatcgtcttgaatctcgtggtataaatccatattcggatttttaagcgcactttgtgtgggttcaataatcaaacctgcgaccttattatcgagcatattaatcagactcttacgctctttttcatgatcattatgcgtattgctaatcagaattgaatagcctttttcagaaagtacccgatcaataccagagataatacttgggaaaatatagtccgcaatatgtgtcgtgatgatcccaatgaccttactatcagcatcattcgtccattcgcgatgccagtcttggacaaacatccccccgccttgaatccgattgatgaaatgttcttcttctaaatcaccgaccgctcggcgaatggtataccgcgaaacatcgtattgtgccatcaattccgtttcagttggtagtttagcgccaattgaatattgacccgaaataatggcttcttttagcgcttcttttacttttttaaatttattttgcatttatttcttcaaattcaatcctgccggttgttggtcggctggtgtgttgtctgccaatacttgatcatgcgctactgttccggcgtaaatgtcgtccgttaaaacgttgcgacggtgtttgataatccggtaaacatgtaacactagcactgccacgttaatggcaagggctaatgcgctgaccgtcatcaaagcagcgctactatgcgtactttggacagagaattgtgagtccgtcacaaaagcgggataactcatcgtaaacatcatccaaaaagccaatgtttgtgcacgtgcttgtaaccaactgccttttttcacaaagaaagcggctaacgtacatgaaatcaataaagccgcgcctgcgtagaatgaatggtcgccaacacagttataaacgtaggcgaagttccaaacatcataggcgataatccaaggccagatttgatcgggccagatcatgtctttttgtttgtcgtggctgatgataatcccaaaccaccctgaaatcgtaatgatattaatgatcccagcaatcccgttcatgatgttccaagcgccaccattcatgacaacgccgtccactaaaccgtgtaagccagccacttggaagtcacggataacggcttccataatgttgaaggccaagatagccggtgggaaaatcaatgcccacttattgtgttgcaatttagggctaaagcgcaacgccataaagcctaaacacccggccaacgctgagtaaactttaacccagtggaaccatgtcccagtactactatcaggtccggccgtcgttggccaaacaaaaatcgttaaaataataggtagtccaacaaataataataatgctacccatttgttagcccgtgcggcttcgtttaacagcattaaagctgcaacgaccccaatccagacgagccaatcaatccccgcaatattttgaaataacatttagcgattattatccagcacttgttgcaaagtcccatttagcatccggtgcatccgctgataaaattcaactttcgattcttgcaggttggtcaccaaccattgaatgatctgcgtcgcgagcgcccaaccataaaagttggccatttcatcgcgcaaagtcggtgggcaatccggttgcaggtcatcaacgacaccggtgaccatgttaaacgcaacgcggtataaaaagcggcccaataaatcgcgattcagggagtgaaatgtgtttaaacaaaaatgacgattggtttcaatataacgcaatagcagatccaaccctttggcccaatcctgttctttttgataggccgccagttgggagacgatctcgcggttataaatccacgcgaccaattcattaatatcggcaaaatggtaataaaaggtgttgcgcgcgacgttcgcctggtgcgtcaactgattaacggtgatgtgatcgaccggcgtcgttgccattagtaatttcagattttgggccaagttttgtttggtatccatttagtggtgaatcagttgcatgaccgaccgagcgattggttgggcgataaacgcttcaacgatgaaagctaaggcaaaattacgcggccatttcgcgccaaaatgggtaatcggcgccattgaaacctgaccactgccaatccaagtgccaatcgccgttagaaaaatggacattaaaaagacgttacacaacgccgtaattaacatctgtgcttgaaagctatcggtctttgccatgagatgactggccaagtattcggctggcttttgggtcaataccactaatacaacgacggccacccagataaacggaatcactcgtagcgtggcttgccacatttgccacgaaaaaccaatctcaaagcccgtgatcaacggagcaattagattgacggataaaattgaaatcaccgcgataaacagcagtgtttccttaaagttttgtggtaatcttttaacaaataacatatgacagtcacaaacgatgctgcttttacagcaatgaccaacggcgaatggtacttcgattcagaagcgacggttcaacaacgtaacgaaacacgcttggcgctacaaaaggccggccaaatcttagataacgcaactcggatggccaccatccaaaaattactcggccacactggtagcgactttttcatcgaaaccggttttgaatttagcttcggccaaaatatttcggtcggcgaccacttttatgctaatcgcaacgttttaatctgtgatgaaggccgcgttacaatcggcgatagctgtaaattcggaccgggtgtatcgcttttaaccccttatcacccacttgatccaacagaacgcgccactaaaaaagaaatctctggtgccattacgattggcaaccacgtctggctaggcgctaacgtcactatcttaccaggtgtaagccttggcaataacgtcgttgtcggtgccggcagtgtcgtcacaaaatcatatccagataacgtgattttggtcggcaatccagcacgcgtcttgcgagaaattcctgctaaataattaggcttcaattgcatagtattcaataatcgcttttaaggctgctgctgctttcgaattgcccactaatttcgtatagtaagccgcaaatcgttcgtccgccacatacatcgccgctaaaccgcggtgcatagctaaactatagcgtggtgtcgccgtttgcagccacgtttggtgggctttaaatgccgcttgtgctgcttctgacggtaattgcggttgcgccaagtaagtttgcaaggccgtcgttaagttggcctcagcggcttgcatcgtcgcatactgcgctttggttaaacccgcgaaatgttgatccgcctcttgcttggcttgttcaccataatttgccgccacttcttgcccatagcgttggtcattttcggcgattgcctgttgtttgaactgttcgaatttagtttggtctgtcatttgagaacctccagtttgattttgaagggtggcatctaactgcgccaaagtcgctgtcaagactgtttgttgcttggcgagttcatcccgtttaaccgctaagtgtgtcagccgttctgctggcggtaacgccaataactgctgaatctccgccaagctaaactgtaattgccggtacatcaagattaactgcagccgatccgcatcctgactcgaatagcttcgataaccattactagcaaccgccggcaccaataacccacgctcgtgataataccgcagcgtgcgctcagaaacaccggtcaattcagcgaaagctttaatctgataattcattcatttgttgattattttttgctcaaccaagaaatcatgcgccacatcacgcgctttacggtgtttaacttgaacctgatagttcatctgttgcatctgatcttcagtaatcttcccggctagcttattgagcgctttggcgacttctggatgggcctttttgaagctctccttcataatcggtgcgccttgataaggtgggaagaaatgccgatcgtcttttaaaacgactagattgtaacgcgccacttccgcatcggtggtataaccatcgaccacatcgaccttgccatccgcaatcgctttgtagcggatgctaggttccataattttagcgtctaatttcaattgatacgtcttcttcaagccttgatagccatctttttgatgataaaagtccgggtcaaagccggccgtaaacgattggttcaaggccgctaaatccgaaatcgttttgacgttatatttcttggcaaaggccgcactgaccgccaagtcataaccattttgatagcgcattggtggcaagtatgccattttgaattgttcttggagcgattctttagcaagttggtaagttttagttggattctggttggtcttggttggcgatttcaccaacgtctgtaagaccgtacccgtaaattctggatagatatcaatttgatcggccttcaacgcgttaaataagaaggtcgtgccaccaaaattcggtttaaccgtcacatcatattgcggatgatcggccaaaatcagatcacgatacatattcatcaagatttcgggttcactgcctaacttgccggcaatcgtaattttggttggtgccgcttggaaccgtgtcacaccttctacgagaccaaaaagccccacaaaaatggccaagctaatcgtaatctttttgaacgataatgtccccaaccagcgaatcagcgcgctaaccactaacgccaaaacagccgagagcgttgccccgaccactaacaaggcgttattattcgactgaatcccgaccaggataaaggtccccagaccgcccgcgccaatcaaggccgccaaagttgccgtcccgataatcatcaccagcgcaatccgcagacccgaaataatcagcggcatcgccaatggcaactcgatgcgtaataagcgcttcgcacgcggtaagccaaaagcaatctccgcttcttttaacgccggatcaatcccgctgagtcccgcgtatgtattttgaaaaatcggcatcaatgcgtacaagactaacgtaatcaccgccggcaccgtgccaatcccaacgagcggaattaataaccctaagagcgctagcgacggaatcgtctgcagaacacttgtcacttgtaacatcgcttcggcaagtttttggtgcgcggttaaaataatcgcaagcggaatcccaatgaccgccgcaattaagagcgccagtaatgagatttccagatgttggccgagcgcttgcaataattcgcccgattgggtcgttaaaatctgctgaatctgttgaatcatcatttaaagcccccgtttcgcaatgagcgtcgttaaatcagtcgtcgtcaattgccgttgtgtttggtcatcaagtgccacgacgaccccttcaggttgtgcgattaaggcttgggccaaggctttgatggacgctgtagtggcaatcgtttccggttgcccgctaacaacggtccccaaatcagcggccactaaatcttgcaccgtcaatgtcgttggttggcgttcaatatcgaaaaattcacggacaaagtcgtttttcggttggttaaaaatcgcttcggccgttccaatttgttgaatgctacccgcccgcatcaccgcaatttcatcccctaaacgcagtgcttctttcatatcatgggtcacaaaaacaaccgtattatgcaattgcttttgcaaatccaatacgagatcttgcaattgcgtgcgcgtcacagggtcgagcgcactaaacggttcatccattaaaatcactttcggtttggtcgccagcgcccgaataatcccaattcgctgttgttggcccccagagagttcactaggatagcggttggcgtatttatctggatccagattaaccagcgttaacagctcccgagcgcgcttttggcgatcagctttagaccactccaaaacttcaagttgaatagtaatattttcttcgattgttaaatgcggaaaaagggcgatattttgcaaaacatagccaatgttaagtcggagggtctgcaaatccatttggtcaattggttgaccatcaattttaatcgtcccactagttggttcaatcaaccggttgatcattttgaccgaggtcgttttcccgctaccactagggccgaccaagacaaatagaccattatctggaatggttaatgttagaccatctaacgcgcggctttgcccgtattgtttggtgacaccttcaaattcaatcatatgaaaacacattttgacaccatcgtgatcggtggcggccctggcggcttagcggcggcttatcgtttggcggaacagcagtccgttttagtcgtcgaaaatgatttatggggcggcacctgtcccaatcgcggctgcgaccctaaaaagatgctctactcggctgttgaagccatcgaccaccagcacaccctgcaatctagtggtttagtcggtaccagttacatcaactggccccaactcatggctttcaagcgccaatacaccactcaaattccggacggcactttaaacggtctgcaaagcgctggcattcgaacagtaaccggcaccgctcactttatcgccgaccaccacttgcgcgtcggtgaaacggattatacggccgaccacttcatcatcgcaaccggtcagaccccaacgctccccgcaattgaaggacgcgatcttttacagaccagcaatcaatttttagacctggatcacctccctgctaaaatagccttcatcggtgccggttatatcgccatcgaattagcgaatatcgccgccacagcgggcgctgaagtccacatcattcaacataacaagcggattttacgcgatttcccagaagccatgacgaccgaattaattacgagcctcgaaaataagggcgttcagttccatttcgaaacaacggtcaccaaagtccatgagaccaccaaaggcctcgtgctaaacaacgcagagggcttcacactaaccgtggatgccgcttttgccgcactcgggcgccacgcgaatatcgatcaactcaacttgcccgcagtggacgttgccattggccaccacggtattcaagtagacgatcatttagtcagcagtaacccgcgggtctacgctattggcgatgtcgttgatcggccccagcctaaattgacgccagtcgccggctttgaagggcgctatgtagccaatcaacttctccaaaccaattcagaccccattgcgtatccgctcattccacacacggtttacgctagcccccagatttcacaagccggtgtttctgttcaaacggcgcaagaaaaccccgaccaatatcgacttaaccaacaaacaaccactaattggtacaccttcaaccggattaaggaaccaaacgccatcgtgaccacgatttttgaccgccaaaccaaccaactcgtcggcgcggcagcctacaccacgattgccgaagaattgatcaattatttgacgcccctcattaaaaatcacacgaccgcggctgaactcaccgatacaatctacaactacccaagtcccgccagtgatttgaaatattactactaattaaataacattttcttttttcgcttttccctgtaaccatagattaaaggccagcacaatcaccaagagcactgtcgcaatcaacataatattgtgtaagccttggtacataatcgcgcgcattgccggtaagaggtgcgctggcaattcgtgcacgcgttggaggttgctcaacttgttcatcatcgccatcgtgattttcccgtgtgatttggcaatcccttgcgttaaagcatggttcaaaatcacgccgtaaatcgacgacatgaacgtttgactcagaatccgtaagagataggcaaaggaggtcgcaatgggcacatcgcgcgtctcagcgtcttcttggacactaatttgcaagacgttaaagctcatcccaagtccgaacccttcaaaagcgcccatcaataataaaaaccaaaatggtgcccgatcgcccatcattaacatcccactaaaggcgattaaaaaagcaaccgtccctaatgttaccacgcggtgtttccctaagcgcggttgaactgccggcccagccagcgaaccaatcaagttggtgaccgcgcctggaatttgcgtcatcccgccgagtaacgcactcaagcctaataacccttgcgcccacattggaatatagatgttaaacgcgataaatgcgccccataaaacgacgaataagataaaatcagtcaccaattgcggatttttaaacaaccggttcggtacgattggatcggccgcgcgatcttccactcggtataagacaactaacaaggccagacctgcgacgattaacccaataatcaaggtcaatgagccggtcccaatcatttgaatcccggtcaataacgtcaccaaactggtaatcataatgccggcgcccaagtaatcgacgctaccacttagatgtgccttaggttgttctttgaagaaataacgtacgcagagaatggataccaatgcgattggcacgttgatgtaaaagacccagtgccaactaaaggtatcaacaatccacccaccaatcaatggcccgacaatcgaagccgcactataactcgcggtcgcgtacccgataacttgcgcccgcttgcgcaaatcttggtataaatcagcataaatgatgaatggcaaggtgttcatcccaccagcgccaatccccataacggttctagcaatcaggaagaaaacgatgtttccagaaaccgcctgaaaaattgaactgaccgcaaacaataacgttgccaattggtaggcccgtcgattgccgatgcgttcacccaacttactccataaaggtgtggccaccgccatccccaacaagaagaccgccacaatccagcccatatattgaatcccgtgcaaatcactaatgattgctggcaaggccgtattgatgattgtcccatcaagccccgccatcatatttgataataataatgccagtgttactaaaagtgtattcttcttattcacctacaatgccgtgtgggcttcaattatttgccgcacctttttccgttccttttcaaagcgccagtgaccgttcattccggaatagtgcattaattggctgagatgatagcctgctggtaaattgccttccagagccttataaaccttgctgcctaaagcaattaaggttgctgattgtggaataccaaggtccttcaagtgatcgagtaaggctgttacattggcctggtccactcaatagtcacaacttttgcgatcaccgtggaagttcccgaataattctggtaatgggcccgcatcgcccgggttcaacccgataaagacgtattgcaccgcactcaatttttgatctaaggctgctttatcaatgtcactcgggaaacctggttcataattttctttgaataacggtaaaatggcttcttccggcgttgcgtcattcaggtcgcttggaattgaccagtataaccaactatcaacggctgtatattttgtcatttaaagattttcgcgcgccgctatcatctgttcgataaattgcgcaatagtctcaacttcggcttcggagtagttggctaaaacagcttcatagttttggcgttgccgttgatgtaattgatgatgcagctcaccgatttcttgcccgcgggccgtaattcttagtacgacggctttttgattctccggcgtgtgaaatttttcaaccaaccggttcttagcgaggcgctgaatatagcgcgataacattccttgcgataattcggattgcgcctgtaactgcttaaacgggattgcttcgcccgcctgtgccagttgcgtcaaaattgccaattccgaatgcgtcagtttcttggcttgggccatcatctccggtgtattgttggcctgtaaatgctgcaatagccaatcgcgctctggatcttgatcattttcagcgtgtaatttggcgatcatttcttggagttttgttaatttagacatatgaaagcagcagtcgtaacagattttaaacaagatcctaaatttgataaccaatttccaacaccaattcttaacccagatgaagtcctcattaacgtgattgcctcatccctttccaatcgggcgcgctccggagcagccggcagccactacacatcgacggaccaactaccaatgattcccggtgtcgatggcattggtactttaccaaccggtgaacaagtttatttcgccagcgaaggtacttttgctgaacaagtcgccgtcaaaaaaggccactgggtaacagttcccgatggccttgatgcgattaaattagcgggcatgatgaatcccgccctttcttcttggatggcactaaactaccgtgccaattttagtaccggtcaaaaagtcatgattctgggcgctaccggtaacgccggtatgatggccgttcagattgccaaacgcttaggcgcttcagaaattatcgccgtcgcccgcaatacagagcagctcaagacactgactgccttaggcgctacacaactggtcgatctctctgcagaacccgcacaacgcaatgctcaactcgctaaagccggcagtgacgttgatatcgtccttgattatctttggggcgacgttgccgcaaacgccatgaccgccatcatcccccaccgtcaaaatgccgaacaacttttgcaatgggttgaaatcggctcatctgccggccaaaccgcacccattccaggcgctgccttccgcgccgttgctttgcgcttaatcggctctggtcagggttcagttgcgcctatcaatatgatgaaatcattgaacgccattttaaccgctgaaaaagaacaaccttttacttttacaactcggacactgccattatcagatgttgaagctggctggcacctccctggcaatgaacgcctcgttttcactatctagctagtcggtccctcgcaccacagcatcgcgccgcatacgaatcccgtattccgccaagccaattacaaccgcaatcgtcaacagaatgaggagactcttccaatcttgtttcaagattaatagatctccagcaaaagcgtaaataaaagcaacgatcgtcgaaccggctaaacaagcccagctttgtgctttagccgttaaatgcgtatcaccggcggctagattcacaaaagcagtcgggatcattggtactgcataaccaatcaagacgcccactgccggatgccgcattttaactagcgcacgataaacgcgtgaatccggctttttgtggcggcgatcccgcactctggtcaataactgcacttgcagtaaattcccgagcgttaaaccaatcgcattaacgacaaagccgccccaatgccctaggcaaaccccgacaagcatcgcgactgctgacgtcggcgcgccaggaatcactgtcatcacgaccatcactaagccaaacaccaagaacgcatacggtcccagatgacgaatatccaacacatattgccgataatcctgccactgcgctaaaaaagcaatgaccgtcctctgatggcgccaaccaatcaataaaacaatcagcgctagtaagatgatacttaccgccagtatcagccgcttttgttggtgcgccgtcattcatccgatgacaccttcttttaagtaatgctcaatcgtcgtcaagataccatcgtgattatgatccgctaacgcaatgttagcggattgtttttttatcgactcataggcattaggcatcgcaaaggcccaaggcgtcatcgtcagcatccccaaatcattttcattatccccaaaagtcatcaattcatcatcggcaatttggtaacgcgtctgtaattgacgtagacagctcaccttatccacaccaacattaccaatcaactccgtttgaaatcccgaattctgactcatcaaacctgccggtaaggagccccgtaactgctgaaccgcctgtgaataatcaacatccggcccaaacgtgatcccgactttagtaatttgatcgttgactgagcgccccgtcaactgatcaaaatgatcgaccaacgtcaccgcatggtaatactgtttaatgattgctagtgtttcgggtgaagcctgtcgcggcacatacgtttgggccaacccagaaattgttttttgcacaattgtccccgctggaaagcccttcgcaattaacgctaacaacgcttgtaaatcatcatcagccaatgcgtctactcgcagtaaatcatccccatgatgcacaatcgccccattttgagaaatgaaatctaacgactgacgatacggatcaaattgattttgcagccgttgatattgcgatccactagcgactacaaacttaacttggcgtgcttgtaacgcctgaaaaactcgcgcaaaccgcgcctgattatattgattattctggtccaaaaaagtcccatccatatcaacaacgatcattttaacacccatttaagcgtatagtttagcaacttgtttttgtaattctggatgtgctaagaattcatcatagtttgtttcggcacgatcaactaaaccgttagctgaaacttcaatgatgtgatctgcaattgtttgaataaattggtgatcatgagatgtaaagatcaaagcacccttgaaatcgatcaaggcatcattcaatgatgtaattgattccaaatccaaatggttagttggatcatctaatagtaaggtgtttgatttttgaagcatgatcttagataggatacaacgaaccttttccccaccagagagaacattaatttccttcgttacttcatccccagagaataacattttccctaagaaaccacgtaagaaggtattgtcgtcttcacccttagcggcaaattgacgtaaccagtctaagataatgagttgatcatcattaaaggctgagttcgtatctcttggtaagtatgattgttgactcgtcacaccccatgtcactgtaccactatctggttctacttcaccagctaagatttgcattaagacagctgtcgcaacgtcatttcgtgaaacgattgctgctttttcgtctggcttaactgagaagctgatgttatctaacactttaacaccatcgattgtttttgagacgttctcaacccgtaaaaggtcatttcccaattcgcgttcgaaatcgaacttaatgaatgggtattgacgtgaagaaggttggatgtcttctaatgtaatcttctctaattgcttcttacgagaagtagcttgttttgattttgaagcattagcactgaaacgtgcgataaagtcttgtaattctttgatttgttcttcttttttagcattaacgtttgattgtaacttagctgccaacttacttgattctaaccagaagtcgtaattaccaacaaatgtcttgatgcgaccaaagtccacatcacacatcattgtacatacttgatttaagaagtaacggtcatgggaaacaacgatcacgatgttcgggaagtcagccaagaagttttctaaccattcaactgaggcactgtccaaaccattagttggttcgtccaataataggatatcaggtttgccaaagagcgcttgaccaagtaaaaccttaatcttttgcccttccatcaattcactcatcttcacatggtgtaaagattcatcgatacctaaagcttggagtaattgagcagcttctgattcagcatcccaaccattcatttcagcgaattcagcttctagatcagcagccttcatcccatcttcttcagtgaattcagctttagcgtatagggcatccttagcttgcatcacttcatataacttcttatgaccttggatcacggtctctaacacttcgaattcttcaaaagcgtagtgatcttgattcaaactcgacatccgttcattagggcccattgagatgtggcctgatgatggttgtaatttaccttctaataattttagaaaagttgacttacctgcaccattggcaccgatcacgccataacaatttccaggtgtaaacttcaaattaacgtcttcatataacttacgcccagaaagcgttaagctcatttcactaacagttatcacctatttgaccttagcaatcttaccttgttgaatatagacgcttagaatcccgatatcggctgggttcaccccaccaatccgacttgcttgtgcaagtgtttcgggttgaattttttgtaatttttgacgaccttctgttgcaaggccttcaattgcatcgtaatcgatattggctggaatcttcttagcttccatccgttttaacttcgcaatcttagccttttccttatcaatataacctgcatatttgacttggatttcaacttgttccacaacacggttatcgattccttcaaccgctggaatgaattgaattaaatcggcatacttcacttctggtcgttttaagaagtcactggctaaaacaccatctttaagtggcgcttcacccttagcagctaaaaaggcttggatttctggtgttggttttaagcgaatcttttctaaacgtgctaattcagcttcaaccgctgcttttttcacttcataactgtcaaaacggtcatcattgattaaacctaattcatgacccttttccgttaaacgcaaatcagcattatcgtgacgaagcattaaacggtattctgcacgtgaggttaatagacggtaaggttccttagtccccttagtgaccaagtcatcgattaagaccccgatgtaagcttcacttcgatccaagatgaatgggtcgcggcccgtttgtttgagggcggcgttaatcccggccatcaaaccttgaccagcagcttcttcataacctgaagtgccgttcatttggccagctgtataaagattttcaaccactttagtttcaagggttggttttaattgccatggttcaacgacatcatattcaatcgcataaccagggcgcatcatttgggcattttctaacccttcgatagaatgaatcattttgtgttggatttcttctggcattgatgttgagaaatcaccaacgtagtattcttctgtttcgtggccttctggttccaagaaaatttggtggcgaggcttatccgcgaagcggacaattttatcttcaattgatgggcaataacgtgggccgacaccttcaatcacaccggtaaacattggggcgcggtcgagattatcgcgaatcacttgatgcgtcgtatcattcgtgtacgtcatccaacaagaaagttggtctttcaaataagcactatcaggtgtttcaaaactaaagtggttcggttccttatcccctggttgttcttccgtctttgaaaaatcgattgttgtgccgtccactcgtggtggtgtccccgttttaaaacgcgtcaacacaaaaccgttatcttcaagactctctgaaagtttaatagaaggaattgaattattaggacctgatgaatacgttaattcaccaatgataatcttgcctcgtgaggctgttccggctgttaaaatcacactgtcagcactgtaacgggcacctgtgttagtcacaatccctttgcagacaccgtcttcaacgatcaatgattcagcaatcccttgacggagtgttaagtggtccgtcgtttcgattgtccgtttcattgtccggtgataggcatgcttatcagcttgggcgcgtaatgcgcggacagctgggcctttacctgtatttagcatccgcatttggatgtaagtcttatcgatattgcggcccatttgaccacctaaggcgtcaatttcacggaccacgatgccttttgccgggccacccaatgatgggttacatggcataaaagcaaccatatctaagttaatcgttaataataatgtttcgcggcccattcgtgcagcagctaatgccgcttcggaacccgcatggccggcaccaacaacaattacgtcgtagtgcgctgcgtcatattctcgcatctatttacctaaacagaattggctaaagagttccgtaatcaattcatctggcgctgaatccccggtaatctcaccgagcttgtcccaacagttggtcatatcgatttgcacgaggtcaactggcatgccagctgcaatcccgctaataacttcatctaatgattgttgtgcttggtttaataagccaatttgacgggcgttggtaatcatcaccgtactttggctattttcaatcccaccgaagaagagtttggcgatttgggcttccaaatcagtcaccccttcactcgttaaaattgacgtttgaatcacttcatctgcacgtactaatgtttggagttcatctaagtccaattgattaggtaagtcagtcttatttaaaataatgatccgttttttatcagttgtcgctgtgattagttcgcgatcttcaatcgttaaaggttcgctttggtttaggaccaataaaatcaagtcggctttggtaattgctgcgcgacttctttcgaccccaatcttttcaaccttatcttcggtatcatgaatccccgccgtatcaaccagcttcaatggtacaccgcggacgttgacgtattcttccaaaacatcacgggtcgttccagcaacatccgtcacaatagctttatcttcatgtaaaagatggtttaacaaacttgatttaccaacgtttggtcgcccaacgatggccgttgccaacccttcacgcaagactttaccttgttgcgctgtttggagtaattcaccaatccgccctttaacaagttcagctttttcaagtaaaattcgggtcgtcatttcatcggtatcgtattcgggatagtcaatgttaacttcgacttgcgccaatacttctaagatttcttggcgtaaattcttaatgagatgcgttaagctcccatccaattgatcaacagcaacttgcattgccctgtcagttttagcccggataagatccatcacagattcagcttgggttaaatcaatccgcccgtttaaaaaggcccgcttcgtgaattcacctggttcggccattcgtgcaccgtaactcatcaatagttgcaagattcggttagtcgccacaatcccaccatgacaattaatttcaatcacatcttcgcgcgtaaatgttttaggcgcacgcatgacagaaaccatgacttcgtcgaccaccgcatccgttttagggtcaataatatggccataattaatcgtatggcttgccactttatcgagatccttgccgcgataaacccgtttaatgatggctaaactgtcatctcctgaaagacgcacaattgaaattgccccctcaccaggtggtgttgagatcgccgtaatcgtatcaaattctgtgactgtcgttggcatttaaaaagaacgggctgattcaaccacaattacccggcgatcgccgcgcccttctgagtgagtttggacgtgacggttgttcgttaaatagccatgaacaatcttccgttcaaacgctggcattggctctaaagtgaccgccttaccagttgcgaccacttctctggccgccttatccgctaaatgtttaacaattgtcgctcttctttgccgataatcgccaacatccagcatcatcaactgttttcctttggtgtgatgatcgtaatacgtttgcgctaaatattggagcgcattgatcgtcttcccgtgtttgccaatcagcaaaccttccttagtcgtctttaaatggaagatgacttgcttgtgttcttttgtaacggtcatcgtgaccggcgtgccaatctgcgctgttatgtcggtaatgtattgctttaaagcttcgatcgtcgcctcacgactctgacgcattggggccttttctggctgatctgctggttcagttgccacgtcttcaacgcttggttgttccggttcaactggggttggttcagcgaccgttatcggatttaacgtaacgattgctggttgcttaccaaaccctaaaaaacccttcttaccttcttcaaggacatcaactgtgaccttatcacgcattaattttaacgctgctaaccccgcatcaattgcggcttgaatatccttaccttcaaaagttggcatttaatctaaatcggtagcggttagttctaaaaagagcgccacatctttggcaatcgaatccgccgccgcttgccaaaaggccggttgcgtcaaatcaacgcctaagtgtttttgcgccaattcttcagtactcatattggccgtgtcttgcaagagtgcgatataatccgcttcaaagtgcggcacactttgcgctttggcgtaaatccccattgaaaagagatatccaaatgtatacgggaagttataaaatggcacatcatcgaagaagaaatgttgtttgtctgcccagaataatgggtcataatctgttagtgcgtccgcataggcttctttttgggcgctcaacatgatgcctttcaaatcgtcaggcgttagtagcccttgttgccgcatttcatagaagcgatgttcaaataaatagcgcgcatgaatattcataaacatatcgatggcgtttgttattttttgatcgagtaagttaatcttcgttgcgcgatcttgtgcttcattgaccgttgcatcgaccacgattaattccgccaacgtcgaagctgtttcggcgacgttcatcgcgtaatcttggcgccagccaggtaattgattaatcatcattgtatggaagccgtgccctaattcatgcgccaaagttgagacgccgccgggtgtgccatcataggtcatgaaaattctaaaatcattcgtctcgggtaaatcggtcatgtagccacccggttgtttacccggccgatcttccgcttcaatccaccgcttttcaaatgccgtttgtgcgacggctgccattttcggactgaaatctcggaaatgcgcaatgataaattcagcagcttcgtcatacgattttttagtcatttgaaaatcatcaaccacgaccggtgcccaagtatcttgccaagctaactgctttttacccattaaagcggccttccggtttaaaaaagcaaccagtggtgctttattttggctgactaccgaccacatcgcatccagtgtggctggttgcatccggttatattccagcggctttttcataaagtcggtggtcccgtgagcttgataagtcgtcaatctaaaaccagctaggtggttcaaggtatccgccaacattggtgagaaacgatcccaggtttgttgccaatttttaaaaacgacttcgcggactttaggatctggatctgattcaaacttattttgggcctgcccagctgataaggtttggtctaaataaggaatctgggtttccgcaacgattgtatcgtagtgatcactccagccttgcaaaccatcgagtgccaattggtccaataatttttcggtttgttcatctaataagtccgccccttgttggcgtttttcccgtaggttgaactgaatcggcgcaaaggctggttggctgactaatgtttcgaattgttcaaccgtcaaggccaccaattttttcgtcaataagacatcaatttgacgggcggtattttgcaattgattaatccggtccatcatgggtgccacttgttggttgcgctcatcgacagattgaatcatgttgacgaaactgcccgtttgcttcaacccggattcaatttgttgtaattgcgtcgtgatggcctgcatttgttcaaaggccggttcatcaaacacaaattgccagtcgcttgtcatttttaaaacaaccggaatctgttgccccaatgcttggagtcgattttctaaggctggtgaggctaagccccctttaaaaatggtttctaaatcccattgttctgagtaagtcatatgaccattgaacaaataccagccaacacattggcagatttagccgcattattaaataggcgtgaagtccctgacgaaatcatggcgaccggaccagaattgatccagtacggtcaacatctcaaggctagccaactatcagatgaagcccacctcggcagcgacttgggcggtgccggtcttttaacccttatcgaacaagctaacacggcgtttttcgatcactttcatctctttgatgatgcagccccgatcgacgccaaattaacgcgcaaagcggtcacgctctatcatctaaaaccaattgatgaccagcacttcttattccgcttgaagcagttggattattaattaacgttttttcgttgctttcttacgtgctttagcaagtgctttttcccgatcacgtttagcttgttctttagcttcacgttcccgacggatcttgaatgggttttgaatcaccattgtttgaccaacagaaaaggcatttgtaactacccagtaaattgaaacggctgacgcaatgttcatcgccatcacgaaaatcatgattggcattacccagagcattgcggtcgttgtagcattcttcgttggttgtgacatcatcgttaaatatgatgtggcaaacgtaaagacggccgccaaaatcgccataataaagtacggatcagctttaccaagttgcatccataagaatgacccactcttcaaagcagatgtccggtagatggcttgatacaaggcaatcaagactggcatttggaccaataatggtaaacaaccaatcacaggattgacccctgcttcagcgtaaagtttctgtgtttcttcacgtaatttttgttgtgtttcaacatctttagaagcgtatttcttttgaagggcttgaatttcaggtgccacttcttgttgcttcatcattgtcttactttgccaccaagttaatggcaaaataatcaaccggataataatggtaaaggcaacgatggcccaaccataactaccaccaaagatatcagctaaccacaacaggaatcgtgagaagttataaataatatagtgatcccagaaaccagtgctagcactgctaacaggtgcagtactacacccagcagcaattagcataaataagaataaactagcgactaataatagtcgtttgcgattttttgaattcacttattcagaagcagaatctgcttcttcctttaataacttagctagcttgaagacatggattaaattttgttttgtttctgccatcgttaattggttagcgccacgtcttgcgatcaccaaaaagtcaacgggttgcaacaaatctggtttcaactccgtaatactttggcgaatataacgtttcacctgattacgcatgactgcgttacccacttttttaccgacagaaagaccgactctaaaatgtttttgaccaggcttatctaagcggtaaaccacgaaattgcggttggccactgattggcttgcatcaaaaaccgtttggaaatcttgttcttttttaacacggtacgactttctcatctatgcagataatacttttctgcccttagcacggcgtcttgcaagtaccttgcgaccgttcttagtattcatacgtttcatgaaaccatgaacacgttctttatggcgtttctttggttgaaatgttctctttgtagtcatatgtttgtcatgttcactcgatttgaaattaagggatctgcagacgttccttatgttgatattcaaatttatcccaaagcgttgaaacttctaaataatctcgaaagttgggttcgttatgctttgacagagttccgagatttaaagagtagttacgcaaaaacaacttttcgtattcttaaacaattccgaaccactggttatgcttatttttctaaaaatgatttctttgaactactagatattccacaaagctattggagtaagcctgcgaacgttgaatctagggttattcgcccaattaaggaagaactaacccctttgtttagaggcctaactatacgaaaaaaatatggtaaaggtcgtgggaaaccagtgattggttatacttttacttggaagcctgaaagaaaagacgcaaacgacttttctcaaggtaagttccaagatgagcgtcaaaaactttttaatatccagaataatggtgaattaacagaacaagaaaaatggcgtgctaccgataaagttaaaggcctaccactaggctcaactgaaaaacagattttagccgaacgacagattgagcatgataaaacaataagagatcagacaagacaagaaatgcttgctgaactccgaaaggggtttggaaatcatgcctaaatgcctaaaacaattagagaacttgctgacgaattgaaggtctctaaacaaactattcaataccactaccaaagactaccaacaaagaaccgacaaaaagatagtcaaggtacaaacatgatcagccttacagctgaaaggattattagggacaaggtagcaaagccttcggtagcaaatacccaacaaacaggtagcaaaaaagtgacaaagactagcaaagaaaataatgagctaattgccactctaagaagagaaatagaagatttaaagtctcaacgtgacaaacagcttgctaccaaagaccgacaaatagatcatctaacaaaattggtggatcagcagcaacaattacaattagcaacagtagcagataaccgtcgattaaaagatcatgtacaaaagctaagtgggcaactaactcaaaaaactaacgacaacttgtcgaccggaaatgatctttttaacatccaagataaaaaaagcaaaatagctaaacagaagattgttaaatctggtagtaataaagatggcatacacacaaatagagctattaaacgttggtggaaattctggtaa

The invention claimed is:

1. A method for alleviating or treating obesity, which comprises administering to a subject in need thereof an effective amount of a composition comprising an active ingredient consisting of *Lactobacillus sakei* OK67 (accession number: KCCM 11670P) strain or a culture thereof, wherein the content of *Lactobacillus sakei* OK67 (accession number: KCCM 11670P) strain is 0.1 to 99% by weight based on the total weight of the composition.

2. The method according to claim 1, wherein the composition is a pharmaceutical composition or a food composition.

3. The method according to claim 1, wherein the method further alleviates or treats at least one selected from the group consisting of diabetes, hypertriglyceridemia, hypercholesterolemia, hyperlipidemia, dyslipidemia, arteriosclerosis, metabolic syndrome, an inflammatory disease and liver damage.

* * * * *